US009157101B2

(12) United States Patent
Piven et al.

(10) Patent No.: US 9,157,101 B2
(45) Date of Patent: *Oct. 13, 2015

(54) *CYANOBACTERIUM* SP. FOR PRODUCTION OF COMPOUNDS

(71) Applicant: Algenol Biofuels Inc., Fort Myers, FL (US)

(72) Inventors: Irina Piven, Berlin (DE); Alexandra Friedrich, Berlin (DE); Ulf Dühring, Berlin (DE); Frank Uliczka, Berlin (DE); Kerstin Baier, Kleinmachnow (DE); Masami Inaba, Berlin (DE); Tuo Shi, San Diego, CA (US); Kui Wang, Fort Myers, FL (US); Heike Enke, Berlin (DE); Dan Kramer, Berlin (DE)

(73) Assignee: Algenol Biotech LLC, Ft. Myers, FL (US)

( * ) Notice: Subject to any disclaimer, the term of this patent is extended or adjusted under 35 U.S.C. 154(b) by 0 days.

This patent is subject to a terminal disclaimer.

(21) Appl. No.: 14/138,123

(22) Filed: Dec. 22, 2013

(65) Prior Publication Data
US 2014/0178958 A1    Jun. 26, 2014

Related U.S. Application Data

(60) Provisional application No. 61/741,000, filed on Dec. 21, 2012, provisional application No. 61/835,294, filed on Jun. 14, 2013.

(51) Int. Cl.
- *C12P 7/06* (2006.01)
- *C12R 1/01* (2006.01)
- *C12N 9/04* (2006.01)
- *C12N 9/88* (2006.01)

(52) U.S. Cl.
CPC .............. *C12P 7/065* (2013.01); *C12N 9/0006* (2013.01); *C12N 9/88* (2013.01); *C12R 1/01* (2013.01); *Y02E 50/17* (2013.01)

(58) Field of Classification Search
CPC ........ C12N 9/0006; C12N 9/88; C12N 15/52; C12N 15/74; C12P 7/065
USPC ........... 435/252.3, 69.1, 190, 232, 320.1, 161
See application file for complete search history.

(56) References Cited

U.S. PATENT DOCUMENTS

| | | |
|---|---|---|
| 6,306,639 B1 | 10/2001 | Woods et al. |
| 6,699,696 B2 | 3/2004 | Woods et al. |
| 7,794,969 B1 | 9/2010 | Reppas et al. |
| 7,968,321 B1 | 6/2011 | Green et al. |
| 7,981,647 B2 | 7/2011 | Berry et al. |
| 8,048,666 B1 | 11/2011 | Green et al. |
| 8,183,027 B2 | 5/2012 | Reppas et al. |
| 8,216,816 B2 | 7/2012 | Green et al. |
| 8,465,954 B2 | 6/2013 | Green et al. |
| 8,846,369 B2 | 9/2014 | Piven et al. |
| 2010/0297736 A1* | 11/2010 | Duhring et al. ............ 435/252.3 |
| 2010/0304456 A1 | 12/2010 | Huntley et al. |
| 2011/0217692 A1 | 9/2011 | Morgan et al. |
| 2011/0287541 A1 | 11/2011 | Cuello et al. |
| 2013/0252300 A1 | 9/2013 | Green et al. |
| 2015/0159178 A1 | 6/2015 | Green et al. |

FOREIGN PATENT DOCUMENTS

| | | |
|---|---|---|
| WO | WO/2009/111513 | 9/2009 |
| WO | WO/2010/044960 | 4/2010 |
| WO | WO/2011/094457 | 8/2011 |
| WO | WO/2012/000057 | 1/2012 |
| WO | WO/2012/101459 | 8/2012 |

OTHER PUBLICATIONS

Sousa et al., Microbiology 148(Pt5):1291-1303, 2002.*
Trautmann et al., GenBank accession No. AGF53389, 2013.*
Neale et al., GenBank accession No. AAA27697, 1993.*
Wang, B. "Application of synthetic biololgy in cyanbacteria and algae", Frontiers in Microbiology, 2012, vol. 3, article 344, pp. 1-15.
Shih, PM. "Improving the coverage of the cyanobacterial phylum using diversity-driven genome sequencing", PNAS, 2013, vol. 110, pp. 1053-1058.
Rippka, R. "Generic assignments, strain histories and properties of pure cultures of cyanobacteria", Journal of General Microbiology, 1979, vol. 111, pp. 1-61.
Deng, M.D. et al., (1999), "Ethanol Synthesis by Genetic Engineering in Cyanobacteria," Applied and Environmental Microbiology, 65:523-528.
Blanch, H.W., (2012), "Bioprocessing for Biofuels," Current Opinion in Biotechnology, 23:390-395.
U.S. Appl. No. 61/184,757, filed Jun. 5, 2009.
U.S. Appl. No. 61/121,532, filed Dec. 12, 2008.
U.S. Appl. No. 61/106,543, filed Oct. 17, 2008.
Chinese Patent Application No. 200980114073.0. Document not available. (Chinese National Phase of PCT/US2009/035937, which is submitted herewith).
Indian Patent Application No. 5951/CHENP/2010. Document not available. (Indian National Phase of PCT/US2009/035937, which is submitted herewith).
European Patent No. 2285948 (European National Phase of PCT/US2009/035937, which is submitted herewith).
U.S. Appl. No. 61/033,411, filed Mar. 3, 2008.
U.S. Appl. No. 61/033,402, filed Mar. 3, 2008.
U.S. Appl. No. 61/044,419, filed Apr. 11, 2008.
U.S. Appl. No. 61/056,999, filed May 29, 2008.
U.S. Appl. No. 61/058,182, filed Jun. 2, 2008.
U.S. Appl. No. 61/077,698, filed Jul. 2, 2008.
U.S. Appl. No. 61/,079,687 filed Jul. 10, 2008.
U.S. Appl. No. 61/079,688, filed Jul. 10, 2008.
U.S. Appl. No. 61/079,656, filed Jul. 10, 2008.
U.S. Appl. No. 61/079,665, filed Jul. 10, 2008.

(Continued)

*Primary Examiner* — Delia Ramirez
(74) *Attorney, Agent, or Firm* — Sam J. Barkley; Lawrence B. Ebert

(57) ABSTRACT

A genetically enhanced cyanobacterial host cell, *Cyanobacterium* sp. ABICyano1, is disclosed. The enhanced *Cyanobacterium* sp. ABICyano1 produces a compound or compounds of interest.

19 Claims, 221 Drawing Sheets

(56) References Cited

OTHER PUBLICATIONS

U.S. Appl. No. 61/079,667, filed Jul. 10, 2008.
U.S. Appl. No. 61/079,673, filed Jul. 10, 2008.
U.S. Appl. No. 61/079,676, filed Jul. 10, 2008.
U.S. Appl. No. 61/079,707, filed Jul. 10, 2008.
U.S. Appl. No. 61/079,699, filed Jul. 10, 2008.
U.S. Appl. No. 61/079,692, filed Jul. 10, 2008.
U.S. Appl. No. 61/086,291, filed Aug. 5, 2008.
U.S. Appl. No. 61/086,288, filed Aug. 5, 2008.
U.S. Appl. No. 61/086,283, filed Aug. 5, 2008.
U.S. Appl. No. 61/086,285 filed Aug. 5, 2008.
U.S. Appl. No. 61/086,417, filed Aug. 5, 2008.
U.S. Appl. No. 61/086,418, filed Aug. 5, 2008.
U.S. Appl. No. 61/086,296, filed Aug. 5, 2008.
U.S. Appl. No. 61/086,300, filed Aug. 5, 2008.
U.S. Appl. No. 61/086,407, filed Aug. 5, 2008.
U.S. Appl. No. 61/086,410, filed Aug. 5, 2008.
U.S. Appl. No. 61/086,412, filed Aug. 5, 2008.
U.S. Appl. No. 61/086,414, filed Aug. 5, 2008.
U.S. Appl. No. 61/100,656, filed Sep. 26, 2008.
U.S. Appl. No. 61/100,665, filed Sep. 26, 2008.
U.S. Appl. No. 61/100,667, filed Sep. 26, 2008.
U.S. Appl. No. 61/100,660, filed Sep. 26, 2008.
U.S. Appl. No. 61/100,663, filed Sep. 26, 2008.
Canadian Patent Application No. 2740400. Document not available. (Canadian National Phase of PCT/US2009/055949, which is submitted herewith).
Chinese Patent Application No. 200980145256.9. Document not available. (Chinese National Phase of PCT/US2009/055949, which is submitted herewith).
European Patent Application No. 2009820965 (EP2344652A0). (Full document not available; EP2344652_A0 submitted herewith. (European National Phase of PCT/US2009/055949, which is submitted herewith).
Israel Patent Application No. 212362. Document not available. (Israel National Phase of PCT/US2009/055949, which is submitted herewith).
Indian Patent Application No. 2444/CHENP/2011. Document not available. (Indian National Phase of PCT/US2009/055949, which is submitted herewith).

\* cited by examiner

```
recombinase of Bacillus thuringiensis serovar israelensis ATCC 35646"
FT   CDS             3615..4000
FT                   /vntifkey="4"
FT                   /label=ORF\2
FT                   /note="orf2"
FT   CDS             complement(4260..6024)
FT                   /vntifkey="4"
FT                   /label=ORF\3
FT                   /note="orf3"
FT   CDS             6078..6341
FT                   /vntifkey="4"
FT                   /label=ORF\5
FT                   /note="orf5"
FT   CDS             6338..6586
FT                   /vntifkey="4"
FT                   /label=ORF\6
FT                   /note="orf6"
FT   rep_origin      3375..3408
FT                   /vntifkey="33"
FT                   /label=Rep_Origin_1
FT                   /note="active site motif of Rep protein"
SQ   Sequence 6628 BP; 2360 A; 1153 C; 1212 G; 2103 t;
```

```
FT                      /label=ORF\3
FT                      /note="orf3"
FT      CDS             9955..10140
FT                      /vntifkey="4"
FT                      /label=ORF\2
FT                      /note="orf2"
FT      rep_origin      complement(9255..9272)
FT                      /vntifkey="33"
FT                      /label=Rep_Origin_1\(potential)
FT                      /note="potential rep origin; match pNostoc (Acc# 881961) nick
site (368-375); on reverse strand"
FT      misc_feature    9515..9548
FT                      /vntifkey="21"
FT                      /label=Rep\motif
FT                      /note="Rep protein active site motif EXXKYXVKKKC"
FT      CDS             6734..9919
FT                      /vntifkey="4"
FT                      /label=ORF\1
FT                      /note="orf1  rep ori binding protein slr7037 homolog Similar to
hypothetical protein slr7037 of plasmid pSYSA (103 kb)  of Synechocystis sp. PCC 6803"
FT      rep_origin      complement(5159..6217)
FT                      /vntifkey="33"
FT                      /label=OriVT
FT      insertion_seq   6234..59
FT                      /source="pABICyano1-6HindIIIBamHI"
FT                      /type="Custom cloned insert"
FT                      /vntifkey="14"
FT                      /label=pABICyano1-6HindIIIBamHI
FT                      /note="Unknown feature type:insert"
FT      terminator      3218..3369
FT                      /vntifkey="43"
FT                      /label=TrbcSABICyano1
FT      promoter        96..378
FT                      /vntifkey="30"
FT                      /label=PnirAABICyano1
FT      CDS             2283..3210
FT                      /vntifkey="4"
FT                      /label=synADHmax
FT      CDS             379..2085
FT                      /vntifkey="4"
FT                      /label=PDCmax
FT      gene            2283..3213
FT                      /vntifkey="60"
FT                      /note="ADH"
FT      gene            379..2088
FT                      /vntifkey="60"
FT                      /note="PDC"
SQ      Sequence 12969 BP; 4009 A; 2277 C; 2560 G; 4123 T;
```

FIG. 7 (continued)

```
FT   CDS             11971..12567
FT                   /vntifkey="4"
FT                   /label=ORF\4
FT                   /note="orf4 Integrase/Recombinase Similar to Site-specific
recombinase of Bacillus thuringiensis serovar israelensis ATCC 35646"
FT   CDS             complement(10881..11645)
FT                   /vntifkey="4"
FT                   /label=ORF\3
FT                   /note="orf3"
FT   CDS             10436..10621
FT                   /vntifkey="4"
FT                   /label=ORF\2
FT                   /note="orf2"
FT   rep_origin      complement(9736..9753)
FT                   /vntifkey="33"
FT                   /label=Rep_Origin_1\(potential)
FT                   /note="potential rep origin; match pNostoc (AxcI M61331) nick
site (358-375); on reverse strand"
FT   misc_feature    9990..10029
FT                   /vntifkey="21"
FT                   /label=Rep\motif
FT                   /note="Rep protein active site motif EXXKYXVKXXD"
FT   CDS             7215..10400
FT                   /vntifkey="4"
FT                   /label=ORF\1
FT                   /note="orf1  rep ori binding protein slr7037 homolog Similar to
hypothetical protein slr7037 of plasmid pSYSA (103 kb)  of Synechocystis sp. PCC 6803"
FT   rep_origin      complement(6640..6698)
FT                   /vntifkey="33"
FT                   /label=OriVT
FT   insertion_seq   6765..69
FT                   /source="pABICyano1-6HindIIIBamHI"
FT                   /type="Custom cloned insert"
FT                   /vntifkey="14"
FT                   /label=pABICyano1-6HindIIIBamHI
FT                   /note="Unknown feature type:insert"
FT   promoter        2112..2680
FT                   /vntifkey="30"
FT                   /label=PrpsLABICyano1
FT   gene            379..2083
FT                   /note="PDC"
FT   gene            2684..3694
FT                   /note="ADH"
FT   CDS             379..2085
FT                   /label=PDCmax
FT   CDS             2684..3691
FT                   /label=synADHmax
FT   promoter        96..378
FT                   /label=PairABICyano1
FT   terminator      3695..3850
FT                   /label=TrbcABICyano1
SQ   Sequence 13449 BP; 4193 A; 2336 C; 2598 G; 4322 t;
```

FIG. 8 (continued)

```
FT   CDS           11555..12241
FT                 /vntifkey="4"
FT                 /label=ORF\4
FT                 /note="orf4 Integrase/Recombinase Similar to Site-specific
recombinase of Bacillus thuringiensis serovar israelensis ATCC 35646"
FT   CDS           complement(10465..11229)
FT                 /vntifkey="4"
FT                 /label=ORF\3
FT                 /note="orf3"
FT   CDS           10020..10205
FT                 /vntifkey="4"
FT                 /label=ORF\2
FT                 /note="orf2"
FT   rep_origin    complement(9320..9337)
FT                 /vntifkey="33"
FT                 /label=Rep_Origin_1\(potential)
FT                 /note="potential rep origin; match pNostoc (Acc# M61381) nick
site (358-375); on reverse strand"
FT   misc_feature  9586..9613
FT                 /vntifkey="21"
FT                 /label=Rep\motif
FT                 /note="Rep protein active site motif KXXHYKVFXXD"
FT   CDS           6799..9984
FT                 /vntifkey="4"
FT                 /label=ORF\1
FT                 /note="orf1  rep ori binding protein slr7037 homolog Similar to
hypothetical protein slr7037 of plasmid pSYSA (103 kb)  of Synechocystis sp. PCC 6803"
FT   rep_origin    complement(6224..6282)
FT                 /vntifkey="32"
FT                 /label=OriVT
FT   insertion_seq 6289..89
FT                 /source="pABICyano1-6HindIIIBamHI"
FT                 /type="Custom cloned insert"
FT                 /vntifkey="16"
FT                 /label=pABICyano1-6HindIIIBamHI
FT                 /note="Unknown feature type:insert"
FT   promoter      2112..2264
FT                 /vntifkey="30"
FT                 /label=PpsbAABICyano1
FT   gene          379..2083
FT                 /note="PDC"
FT   gene          2268..3278
FT                 /note="ADH"
FT   CDS           379..2085
FT                 /label=PDCmax
FT   CDS           2268..3275
FT                 /label=synADHmax
FT   promoter      96..378
FT                 /label=PnirAABICyano1
FT   terminator    3279..3434
FT                 /label=TrbcSABICyano1
SQ   Sequence 13033 BP; 4048 A; 2285 C; 2558 G; 4142 T;
```

FIG. 9 (continued)

```
FT                      /note="orf5"
FT      CDS             11603..12289
FT                      /vntifkey="4"
FT                      /label=ORF\4
FT                      /note="orf4 Integrase/Recombinase Similar to Site-specific
recombinase of Bacillus thuringiensis serovar israelensis ATCC 35646"
FT      CDS             complement(10513..11277)
FT                      /vntifkey="4"
FT                      /label=ORF\3
FT                      /note="orf3"
FT      CDS             10066..10253
FT                      /vntifkey="4"
FT                      /label=ORF\2
FT                      /note="orf2"
FT      rep_origin      complement(9368..9385)
FT                      /vntifkey="33"
FT                      /label=Rep_Origin_1\(potential)
FT                      /note="potential rep origin; match pNoster (Acc# M81381) nick
site (358-375); on reverse strand"
FT      misc_feature    9628..9661
FT                      /vntifkey="21"
FT                      /label=Rep\motif
FT                      /note="Rep protein active site motif EXXKYXVKXXD"
FT      CDS             8847..10032
FT                      /vntifkey="4"
FT                      /label=ORF\1
FT                      /note="orf1  rep ori binding protein slr7037 homolog Similar to
hypothetical protein slr7037 of plasmid pSYSA (103 kb)  of Synechocystis sp. PCC 6803"
FT      rep_origin      complement(5272..6390)
FT                      /vntifkey="33"
FT                      /label=OriVT
FT      insertion_seq   6357..89
FT                      /source="pASICyano1-6HindIIIBamHI"
FT                      /type="Custom cloned insert"
FT                      /vntifkey="14"
FT                      /label=pASICyano1-6HindIIIBamHI
FT                      /note="Unknown feature type:insert"
FT      CDS             2316..3323
FT                      /vntifkey="4"
FT                      /label=synADH
FT      CDS             494..2198
FT                      /label=PDC
FT      gene            2316..3326
FT                      /note="ADH"
FT      gene            494..2201
FT                      /note="PDC"
FT      promoter        101..493
FT                      /vntifkey="30"
FT                      /label=PpetEASICyano1
SQ      Sequence 13061 BP; 4061 A; 2280 C; 2573 G; 4167 t;
```

FIG. 10 (continued)

```
FT                      /label=pABICyano1-6HindIIIBamHI
FT                      /note="Unknown feature type:insert"
FT   misc_difference    4137..4140
FT                      /vntifkey="95"
FT                      /label=TA\in\pMA\data
FT   rep_origin         complement(5753..6011)
FT                      /vntifkey="33"
FT                      /label=OriVT
FT   CDS                7328..10513
FT                      /vntifkey="4"
FT                      /label=ORF\1
FT                      /note="orf1  rep ori binding protein alr7097 homolog Similar to
hypothetical protein alr7097 of plasmid pSYSA (103 kb)  of Synechocystis sp. PCC 6803"
FT   misc_feature       10109..10142
FT                      /vntifkey="21"
FT                      /label=Rep\motif
FT                      /note="Rep protein active site motig EXXKYXVKKXD"
FT   rep_origin         complement(9843..9866)
FT                      /vntifkey="33"
FT                      /label=Rep_Origin_1\(potential)
FT                      /note="potential rep origin; match pNostoc (Acc# M81381) nick
site (356-375); on reverse strand"
FT   CDS                10549..10734
FT                      /vntifkey="4"
FT                      /label=ORF\2
FT                      /note="orf2"
FT   CDS                complement(10994..11759)
FT                      /vntifkey="4"
FT                      /label=ORF\3
FT                      /note="orf3"
FT   CDS                12084..12779
FT                      /vntifkey="4"
FT                      /label=ORF\4
FT                      /note="orf4 Integrase/Recombinase Similar to Site-specific
recombinase of Bacillus thuringiensis serovar israelensis ATCC 35646"
FT   CDS                12913..13075
FT                      /label=ORF\5
FT                      /note="orf5"
FT   CDS                13072..13329
FT                      /label=ORF\6
FT                      /note="orf6"
FT   CDS                4695..5510
FT                      /label=Km**
FT                      /note=" maximal codon optimized kanamycin resistance gene "
FT   promoter           4166..4693
FT                      /vntifkey="30"
FT                      /label=PrptcLABICyano1
FT   promoter           96..494
FT                      /label=FpstKABICyano1
FT   CDS                492..2198
FT                      /label=PDCmx
SQ   Sequence 13982 BP; 4246 A; 2339 C; 2611 G; 4366 t;
```

FIG. 11 (continued)

```
FT   promoter        1..263
FT                   /vntifkey="30"
FT                   /label=PrbrAABICyano1
FT   insertion_seq   6280..13113
FT                   /source="pABICyano1-6HindIIIBamHI"
FT                   /type="Custom cloned insert"
FT                   /vntifkey="14"
FT                   /label=pABICyano1-6HindIIIBamHI
FT                   /note="Unknown feature type:insert"
FT   rep_origin      complement(5215..6273)
FT                   /vntifkey="33"
FT                   /label=OriVT
FT   CDS             6790..9975
FT                   /vntifkey="4"
FT                   /label=ORF\1
FT                   /note="orf1  rep ori binding protein slr7037 homolog Similar to
hypothetical protein slr7037 of plasmid pSYSA (103 kb)  of Synechocystis sp. PCC 6803"
FT   misc_feature    9571..9603
FT                   /vntifkey="21"
FT                   /label=Rep\motif
FT                   /note="Rep protein active site motig EXXEYKVKXXD"
FT   rep_origin      complement(9311..9328)
FT                   /vntifkey="33"
FT                   /label=Rep_Origin_1\(potential)
FT                   /note="potential rep origin; match pNostoc (Acc# M81381) nick
site (356-375); on reverse strand"
FT   CDS             10011..10196
FT                   /label=ORF\2
FT                   /note="orf2"
FT   CDS             complement(10436..11228)
FT                   /label=ORF\3
FT                   /note="orf3"
FT   CDS             11546..12232
FT                   /vntifkey="4"
FT                   /label=ORF\4
FT                   /note="orf4 Integrase/Recombinase Similar to Site-specific
recombinase of Bacillus thuringiensis serovar israelensis ATCC 35646"
FT   CDS             12274..12537
FT                   /label=ORF\5
FT                   /note="orf5"
FT   CDS             12534..12792
FT                   /label=ORF\6
FT                   /note="orf6"
FT   CDS             4157..4972
FT                   /label=Km**
FT                   /note=" maximal codon optimized kanamycin resistance gene "
FT   CDS             284..1890
FT                   /label=cmPDCABICyano1(opt3)
FT   promoter        3692..4155
FT                   /label=PrbcLABICyano1
SQ   Sequence 13119 BP; 4182 A; 2307 C; 2512 G; 4118 T;
```

FIG. 12 (continued)

```
FT   promoter         1214..1677
FT                    /vntifkey="30"
FT                    /label=PrbcABICyano1
FT   CDS              10925..12631
FT                    /vntifkey="4"
FT                    /label=zmPCCABICyano1(opt3)
FT   CDS              1679..2494
FT                    /vntifkey="4"
FT                    /label=Km**
FT                    /note=" maximal codon optimized kanamycin resistance gene "
FT   CDS              10056..10304
FT                    /vntifkey="4"
FT                    /label=ORF\6
FT                    /note="orf6"
FT   CDS              9796..10059
FT                    /vntifkey="4"
FT                    /label=ORF\5
FT                    /note="orf5"
FT   CDS              9068..9754
FT                    /vntifkey="4"
FT                    /label=ORF\4
FT                    /note="orf4 Integrase/Recombinase Similar to Site-specific
recombinase of Bacillus thuringiensis serovar israelensis ATCC 35646"
FT   CDS              complement(7978..8742)
FT                    /vntifkey="4"
FT                    /label=ORF\3
FT                    /note="orf3"
FT   CDS              7533..7718
FT                    /vntifkey="4"
FT                    /label=ORF\2
FT                    /note="orf2"
FT   rep_origin       complement(6833..6850)
FT                    /label=Rep_Origin_1\(potential)
FT                    /note="potential rep origin; match pNostoc (Acc# M81381) nick
site (356-375); on reverse strand"
FT   misc_feature     7093..7126
FT                    /label=Rep\motif
FT                    /note="Rep protein active site motif EKKKYKVRKXXD"
FT   CDS              4312..7497
FT                    /label=ORF\1
FT                    /note="orf1  rep ori binding protein alr7037 homolog Similar to
hypothetical protein alr7037 of plasmid pSYSA (103 kb)  of Synechocystis sp. PCC 6803"
FT   rep_origin       complement(2737..3795)
FT                    /label=OriVT
FT   insertion_seq    3802..10635
FT                    /source="pABICyano1-6HindIIIBamHI"
FT                    /type="Custom cloned insert"
FT                    /label=pABICyano1-6HindIIIBamHI
FT                    /note="Unknown feature type:insert"
FT   promoter         10682..10924
FT                    /label=PnirAABICyano1
SQ   Sequence 12648 BP; 3928 A; 2331 C; 2557 G; 3832 t;
```

FIG. 13 (continued)

```
FT                      /note="orf6"
FT      CDS             10323..10506
FT                      /vntifkey="4"
FT                      /label=ORF\5
FT                      /note="orf5"
FT      CDS             9596..10281
FT                      /vntifkey="4"
FT                      /label=ORF\4
FT                      /note="orf4 Integrase/Recombinase Similar to Site-specific
recombinase of Bacillus thuringiensis serovar israelensis ATCC 35646"
FT      CDS             complement(8598..9269)
FT                      /vntifkey="4"
FT                      /label=ORF\3
FT                      /note="orf3"
FT      CDS             8060..8245
FT                      /vntifkey="4"
FT                      /label=ORF\2
FT                      /note="orf2"
FT      rep_origin      complement(7360..7377)
FT                      /vntifkey="33"
FT                      /label=Rep_Origin_1\(potential)
FT                      /note="potential rep origin; match pNostoc (Acc# M81381) nick
site (358-375); on reverse strand"
FT      misc_feature    7626..7653
FT                      /vntifkey="21"
FT                      /label=Rep\motif
FT                      /note="Rep protein active site motig EXXKYXYXXKD"
FT      CDS             4839..6024
FT                      /label=ORF\1
FT                      /note="orf1  rep ori binding protein slr7037 homolog Similar to
hypothetical protein slr7037 of plasmid pSYSA (103 kb)  of Synechocystis sp. PCC 6803"
FT      rep_origin      complement(3864..4322)
FT                      /label=OriVT
FT      insertion_seq   4329..11162
FT                      /source="pABICyano1-6HindIIIBamHI"
FT                      /type="Custom cloned insert"
FT                      /label=pABICyano1-6HindIIIBamHI
FT                      /note="Unknown feature type:insert"
FT      promoter        11169..11451
FT                      /label=PairAABICyano1
FT      promoter        56..626
FT                      /label=PrpsLABICyano1
FT      CDS             630..1637
FT                      /vntifkey="4"
FT                      /label=SynADH(ABICyanolopt3)
FT      terminator      1653..1698
FT                      /label=Terminator_1
FT                      /note="Ter_B0011"
FT      gene            630..1640
FT                      /note="SycADHopti"
FT      terminator      1..56
FT                      /label=dsrA
SQ      Sequence 13165 BP; 4190 A; 2319 C; 2522 G; 4134 t;
```

FIG. 14 (continued)

```
FT   CDS           complement(11036..11800)
FT                 /vntifkey="4"
FT                 /label=ORF\3
FT                 /note="orf3"
FT   CDS           10591..10776
FT                 /vntifkey="4"
FT                 /label=ORF\2
FT                 /note="orf2"
FT   rep_origin    complement(9891..9908)
FT                 /vntifkey="33"
FT                 /label=Rep_Origin_1\(potential)
FT                 /note="potential rep origin; match pNostoc (Acc# M81381) nick
site (358-375); on reverse strand"
FT   misc_feature  10151..10184
FT                 /vntifkey="21"
FT                 /label=Rep\motif
FT                 /note="Rep protein active site motif EXXKYYVKXXE"
FT   CDS           7376..10855
FT                 /vntifkey="4"
FT                 /label=ORF\1
FT                 /note="orf1  rep oxi binding protein slr7037 homolog Similar to
hypothetical protein slr7037 of plasmid pSYSA (103 kb)  of Synechocystis sp. PCC 6803"
FT   rep_origin    complement(5796..6853)
FT                 /vntifkey="33"
FT                 /label=OriVT
FT   insertion_seq 6960..99
FT                 /source="pABICyano1-6HindIIIBamHI"
FT                 /type="Custom cloned insert"
FT                 /vntifkey="14"
FT                 /label=pABICyano1-6HindIIIBamHI
FT                 /note="Unknown feature type:insert"
FT   promoter      2267..2835
FT                 /vntifkey="30"
FT                 /label=PrpsLABICyano
FT   gene          534..2243
FT                 /vntifkey="60"
FT                 /note="PDC"
FT   gene          2839..3849
FT                 /note="ADH"
FT   CDS           534..2240
FT                 /label=PDC(opt)
FT   CDS           2839..3846
FT                 /label=synADH(opt)
FT   terminator    3950..4005
FT                 /label=TrbcSABICyano1
FT   promoter      101..509
FT                 /label=PpetJABICyano
FT   CDS           510..533
FT                 /label=petJABICyano
SQ   Sequence 13604 BP; 4252 A; 2378 C; 2622 G; 4352 t;
```

FIG. 15 (continued)

```
FT                      /label=Km**
FT                      /note="Km**"
FT      CDS             12178..12426
FT                      /vntifkey="4"
FT                      /label=ORF\6
FT                      /note="orf6"
FT      CDS             11910..12181
FT                      /vntifkey="4"
FT                      /label=ORF\5
FT                      /note="orf5"
FT      CDS             11190..11876
FT                      /vntifkey="4"
FT                      /label=ORF\4
FT                      /note="orf4 Integrase/Recombinase Similar to Site-specific
recombinase of Bacillus thuringiensis serovar israelensis ATCC 35646"
FT      CDS             complement(10190..10864)
FT                      /vntifkey="4"
FT                      /label=ORF\3
FT                      /note="orf3"
FT      CDS             9655..9840
FT                      /vntifkey="4"
FT                      /label=ORF\2
FT                      /note="orf2"
FT      rep_origin      complement(8955..8972)
FT                      /vntifkey="33"
FT                      /label=Rep_Origin_1
FT                      /note="potential Rep origin; match pAnstoc (Acc# M81381) nick
site (358-375); on reverse strand"
FT      misc_feature    9215..9248
FT                      /vntifkey="21"
FT                      /label=Rep\motif
FT                      /note="Rep protein active site motig EXXKYXVXXXD"
FT      CDS             6434..9619
FT                      /vntifkey="4"
FT                      /label=ORF\1
FT                      /note="orf1  rep ori binding protein slr7037 homolog Similar to
hypothetical protein slr7037 of plasmid pSYSA (105 kb) of Synechocystis sp. PCC 6803"
FT      primer_bind     complement(8222..8253)
FT                      /vntifkey="28"
FT                      /label=Bcm-F
FT      primer_bind     4904..4935
FT                      /vntifkey="28"
FT                      /label=Bcm-R
FT      rep_origin      complement(4059..5917)
FT                      /vntifkey="33"
FT                      /label=OriVT
FT      promoter        2064..2132
FT                      /vntifkey="30"
FT                      /label=PrbcL*(optRBS)
FT                      /note="improved version of the rbcL promoter from PCC6803"
FT      promoter        1..287
FT                      /vntifkey="30"
FT                      /label=PnirA*2
FT                      /note="improved version of nirA promoter"
FT      CDS             285..1991
FT                      /vntifkey="4"
FT                      /label=zmPDC(opt1)
SQ      Sequence 12763 BP; 3948 A; 2245 C; 2490 G; 4080 t;
```

FIG. 16 (continued)

```
FT                      /vntifkey="43"
FT                      /label=TrbcASICyano1
FT      promoter        3335..3798
FT                      /vntifkey="30"
FT                      /label=PrbcASICyano1
FT      CDS             3800..4615
FT                      /vntifkey="4"
FT                      /label=Sm**
FT                      /note="SM**"
FT      CDS             12177..12425
FT                      /vntifkey="4"
FT                      /label=ORF\6
FT                      /note="orf6"
FT      CDS             11917..12180
FT                      /vntifkey="4"
FT                      /label=ORF\5
FT                      /note="orf5"
FT      CDS             11189..11875
FT                      /vntifkey="4"
FT                      /label=ORF\4
FT                      /note="orf4 Integrase/Recombinase Similar to Site-specific
recombinase of Bacillus thuringiensis serovar israelensis ATCC 35646"
FT      CDS             complement(10093..10863)
FT                      /vntifkey="4"
FT                      /label=ORF\3
FT                      /note="orf3"
FT      CDS             9654..9839
FT                      /vntifkey="4"
FT                      /label=ORF\2
FT                      /note="orf2"
FT      rep_origin      complement(8954..8971)
FT                      /vntifkey="33"
FT                      /label=Rep_Origin_1
FT                      /note="potential rep origin; match pNostoc (Acc# N81361) nick
site (358-375); on reverse strand"
FT      misc_feature    9214..9247
FT                      /vntifkey="21"
FT                      /label=Rep\motif
FT                      /note="Rep protein active site motif EXXKYXYXXXC"
FT      CDS             6433..9610
FT                      /vntifkey="4"
FT                      /label=ORF\1
FT                      /note="orf1 rep ori binding protein slr7037 homolog Similar to
hypothetical protein slr7037 of plasmid pSYSA (103 kb) of Synechocystis sp. PCC 6803"
FT      primer_bind     complement(5221..5252)
FT                      /vntifkey="28"
FT                      /label=Som-F
FT      primer_bind     4903..4934
FT                      /vntifkey="28"
FT                      /label=Som-R
FT      rep_origin      complement(4858..5916)
FT                      /vntifkey="33"
FT                      /label=OriVT
FT      promoter        2063..2131
FT                      /vntifkey="30"
FT                      /label=Prbc*(optRBS)
FT                      /note="improved version of rbcL promoter from PCC6803"
SQ      Sequence 12762 BP; 3943 A; 2248 C; 2489 G; 4061 t;
```

FIG. 17 (continued)

```
FT                      /label=Km**
FT                      /note="Km**"
FT      CDS             13141..13389
FT                      /vntifkey="4"
FT                      /label=ORF\6
FT                      /note="orf6"
FT      CDS             12881..13144
FT                      /vntifkey="4"
FT                      /label=ORF\5
FT                      /note="orf5"
FT      CDS             12153..12839
FT                      /vntifkey="4"
FT                      /label=ORF\4
FT                      /note="orf4 Integrase/Recombinase Similar to Site-specific
recombinase of Bacillus thuringiensis serovar israelensis ATCC 35646"
FT      CDS             complement(11063..11827)
FT                      /vntifkey="4"
FT                      /label=ORF\3
FT                      /note="orf3"
FT      CDS             10618..10803
FT                      /vntifkey="4"
FT                      /label=ORF\2
FT                      /note="orf2"
FT      rep_origin      complement(9919..9935)
FT                      /vntifkey="33"
FT                      /label=Rep_Origin_1
FT                      /note="potential rep origin; match pNostoc (Acc# M81381) nick
site (358-375); on reverse strand"
FT      misc_feature    10178..10211
FT                      /vntifkey="21"
FT                      /label=Rep\motif
FT                      /note="Rep protein active site motig EXXKYXVKKXD"
FT      CDS             7397..10582
FT                      /vntifkey="4"
FT                      /label=ORF\1
FT                      /note="orf1  rep ori binding protein slr7037 homolog Similar to
hypothetical protein slr7037 of plasmid pSYSA (103 kb)  of Synechocystis sp. PCC 6803"
FT      primer_bind     complement(6185..6216)
FT                      /vntifkey="20"
FT                      /label=Kom-F
FT      primer_bind     5667..5690
FT                      /vntifkey="20"
FT                      /label=Kom-R
FT      rep_origin      complement(5822..6880)
FT                      /vntifkey="33"
FT                      /label=OriVT
FT      promoter        3027..3095
FT                      /vntifkey="30"
FT                      /label=Prbc*(optRBS)
FT                      /note="improved version of rbcL promoter from PCC6803"
FT      CDS             complement(54..1166)
FT                      /vntifkey="4"
FT                      /label=corR
FT      promoter        1168..1247
FT                      /vntifkey="30"
FT                      /label=PcorT*1
FT                      /note="improved version of corT promoter from PCC6803"
FT      CDS             1246..2954
FT                      /vntifkey="4"
FT                      /label=zmPDC(opt1)
SQ      Sequence 13726 BP; 4160 A; 2504 C; 2756 G; 4306 t;
```

FIG. 18 (continued)

```
FT   CDS             13141..13389
FT                   /vntifkey="4"
FT                   /label=ORF\6
FT                   /note="orf6"
FT   CDS             12891..13144
FT                   /vntifkey="4"
FT                   /label=ORF\5
FT                   /note="orf5"
FT   CDS             12163..12839
FT                   /vntifkey="4"
FT                   /label=ORF\4
FT                   /note="orf4 Integrase/Recombinase Similar to Site-specific
recombinase of Bacillus thuringiensis serovar israelensis ATCC 35646"
FT   CDS             complement(11063..11827)
FT                   /vntifkey="4"
FT                   /label=ORF\3
FT                   /note="orf3"
FT   CDS             10618..10803
FT                   /vntifkey="4"
FT                   /label=ORF\2
FT                   /note="orf2"
FT   rep_origin      complement(9918..9935)
FT                   /vntifkey="33"
FT                   /label=Rep_Origin_1
FT                   /note="potential rep origin; match pRostoc (Acc# N81381) nick
site (386-375); on reverse strand"
FT   misc_feature    10178..10211
FT                   /vntifkey="21"
FT                   /label=Rep\motif
FT                   /note="Rep protein active site motif EXXKIYVKKND"
FT   CDS             7387..10502
FT                   /vntifkey="4"
FT                   /label=ORF\1
FT                   /note="orf1  rep ori binding protein slr7037 homolog Similar to
hypothetical protein slr7037 of plasmid pSYSA (103 kb)  of Synechocystis sp. PCC 6803"
FT   primer_bind     complement(6185..6216)
FT                   /vntifkey="28"
FT                   /label=Bom-F
FT   primer_bind     5867..5898
FT                   /vntifkey="28"
FT                   /label=Bom-R
FT   rep_origin      complement(5022..6080)
FT                   /vntifkey="33"
FT                   /label=OriVT
FT   promoter        3027..3095
FT                   /vntifkey="30"
FT                   /label=Prbc* (optRBS)
FT                   /note="improved version of rbcL promoter from PCC6803"
FT   CDS             complement(54..1166)
FT                   /vntifkey="4"
FT                   /label=corR
FT   promoter        1169..1247
FT                   /vntifkey="30"
FT                   /label=PcorT*2
FT                   /note="improved version of corT promoter from PCC6803"
FT   CDS             1248..2954
FT                   /vntifkey="4"
FT                   /label=zmPDC(opt1)
SQ   Sequence 13726 BP; 4162 A; 2504 C; 2763 G; 4297 t;
```

FIG. 19 (continued)

```
FT   CDS              13141..13309
FT                    /vntifkey="4"
FT                    /label=ORF\6
FT                    /note="orf6"
FT   CDS              12881..13144
FT                    /vntifkey="4"
FT                    /label=ORF\5
FT                    /note="orf5"
FT   CDS              12153..12839
FT                    /vntifkey="4"
FT                    /label=ORF\4
FT                    /note="orf4 Integrase/Recombinase Similar to Site-specific
recombinase of Bacillus thuringiensis serovar israelensis ATCC 35646"
FT   CDS              complement(11063..11827)
FT                    /vntifkey="4"
FT                    /label=ORF\3
FT                    /note="orf3"
FT   CDS              10618..10803
FT                    /vntifkey="4"
FT                    /label=ORF\2
FT                    /note="orf2"
FT   rep_origin       complement(9916..9935)
FT                    /vntifkey="33"
FT                    /label=Rep_Origin_1
FT                    /note="potential rep origin; match pNostoc (AccN M61391) nick
site (355-373); on reverse strand"
FT   misc_feature     10178..10211
FT                    /vntifkey="21"
FT                    /label=Rep\motif
FT                    /note="Rep protein active site motif EXXNYKVRXXD"
FT   CDS              7397..10582
FT                    /vntifkey="4"
FT                    /label=ORF\1
FT                    /note="orf1  rep ori binding protein slr7037 homolog Similar to
hypothetical protein slr7037 of plasmid pSYSA (103 kb)  of Synechocystis sp. PCC 6803"
FT   primer_bind      complement(6135..6218)
FT                    /vntifkey="28"
FT                    /label=Bom-F
FT   primer_bind      5867..5890
FT                    /vntifkey="28"
FT                    /label=Bom-R
FT   rep_origin       complement(5822..6880)
FT                    /vntifkey="33"
FT                    /label=OriVT
FT   promoter         3027..3095
FT                    /vntifkey="30"
FT                    /label=PrbcL*(optRBS)
FT                    /note="improved version of rbcL promoter from PCC6803"
FT   promoter         1169..1247
FT                    /vntifkey="30"
FT                    /label=PcorT*3
FT                    /note="improved version of corT promoter from PCC6803"
FT   CDS              complement(54..1166)
FT                    /vntifkey="4"
FT                    /label=corR
FT   CDS              1248..2954
FT                    /vntifkey="4"
FT                    /label=zmPDC(opt1)
SQ   Sequence 13736 BP; 4162 A; 2593 C; 2785 G; 4396 t;
```

FIG. 20 (continued)

```
FT                      /label=synADH(opt1)
FT      terminator      3441..3596
FT                      /vntifkey="43"
FT                      /label=TrbcABICyano1
FT      promoter        3633..4096
FT                      /vntifkey="30"
FT                      /label=PrbcABICyano1
FT      CDS             4098..4913
FT                      /vntifkey="4"
FT                      /label=Km**
FT                      /note="Km**"
FT      CDS             12475..12723
FT                      /vntifkey="4"
FT                      /label=ORF\6
FT                      /note="orf6"
FT      CDS             12215..12478
FT                      /vntifkey="4"
FT                      /label=ORF\5
FT                      /note="orf5"
FT      CDS             11437..12173
FT                      /vntifkey="4"
FT                      /label=ORF\4
FT                      /note="orf4 Integrase/Recombinase Similar to Site-specific
recombinase of Bacillus thuringiensis serovar israelensis ATCC 35646"
FT      CDS             complement(10397..11161)
FT                      /vntifkey="4"
FT                      /label=ORF\3
FT                      /note="orf3"
FT      CDS             9952..10137
FT                      /vntifkey="4"
FT                      /label=ORF\2
FT                      /note="orf2"
FT      rep_origin      complement(9252..9269)
FT                      /vntifkey="33"
FT                      /label=Rep_Origin_1
FT                      /note="potential rep origin; match pNostoc (Acc# N81361) nick
site (358-375); on reverse strand"
FT      misc_feature    9512..9545
FT                      /vntifkey="21"
FT                      /label=Rep\motif
FT                      /note="Rep protein active site motig EXKYXVKXXE"
FT      CDS             6731..9818
FT                      /vntifkey="4"
FT                      /label=ORF\1
FT                      /note="orf1 rep ori binding protein slr7037 homolog Similar to
hypothetical protein slr7037 of plasmid pSYSA (103 kb) of Synechocystis sp. PCC 6803"
FT      primer_bind     complement(5519..5556)
FT                      /vntifkey="28"
FT                      /label=Scm-F
FT      primer_bind     5201..5232
FT                      /vntifkey="28"
FT                      /label=Scm-R
FT      rep_origin      complement(5156..6214)
FT                      /vntifkey="33"
FT                      /label=OriVT
FT      promoter        2361..2428
FT                      /vntifkey="30"
FT                      /label=Prbc*(optRBS)
FT                      /note="improved version of rbcL promoter from PCC6803"
SQ      Sequence 12973 BP; 3972 A; 2324 C; 2561 G; 4116 t;
```

FIG. 21 (continued)

```
FT                      /vntifkey="4"
FT                      /label=ORF\6
FT                      /note="orf6"
FT      CDS             12120..12391
FT                      /vntifkey="4"
FT                      /label=ORF\5
FT                      /note="orf5"
FT      CDS             11400..12086
FT                      /vntifkey="4"
FT                      /label=ORF\4
FT                      /note="orf4 Integrase/Recombinase Similar to Site-specific
recombinase of Bacillus thuringiensis serovar israelensis ATCC 35646"
FT      CDS             complement(10310..11074)
FT                      /vntifkey="4"
FT                      /label=ORF\3
FT                      /note="orf3"
FT      CDS             9865..10080
FT                      /vntifkey="4"
FT                      /label=ORF\2
FT                      /note="orf2"
FT      rep_origin      complement(9165..9182)
FT                      /vntifkey="33"
FT                      /label=Rep_Origin_1
FT                      /note="potential rep origin; match pNostoc (Acc# M81381) nick
site (356-375); on reverse strand"
FT      misc_feature    9425..9458
FT                      /vntifkey="21"
FT                      /label=Rep\motif
FT                      /note="Rep protein active site motig KXXKXXVKXXD"
FT      CDS             6644..8829
FT                      /vntifkey="4"
FT                      /label=ORF\1
FT                      /note="orf1  rep ori binding protein slr7037 homolog Similar to
hypothetical protein slr7037 of plasmid pSYSA (103 kb)  of Synechocystis sp. PCC 6803"
FT      primer_bind     complement(5432..5463)
FT                      /vntifkey="28"
FT                      /label=Bom-F
FT      primer_bind     6114..6145
FT                      /vntifkey="28"
FT                      /label=Bom-R
FT      rep_origin      complement(6069..6137)
FT                      /vntifkey="33"
FT                      /label=OriVT
FT      promoter        2274..2342
FT                      /vntifkey="30"
FT                      /label=Prb-c*(optRBS)
FT                      /note="improved version of rbcL promoter from PCC6803"
FT      CDS             503..2201
FT                      /vntifkey="4"
FT                      /label=smPCC(opt1)
FT      CDS             complement(69..392)
FT                      /vntifkey="4"
FT                      /label=smtB
FT                      /note="smtB gene from Synechococcus PCC7002"
FT      promoter        394..494
FT                      /vntifkey="30"
FT                      /label=PsmtA*1
FT                      /note="improved version of smtA promoter from PCC7002"
SQ      Sequence 12973 BP; 3974 A; 2324 C; 2562 G; 4113 t;
```

FIG. 22 (continued)

```
FT                      /label=Km**
FT                      /note="Km**"
FT      CDS             12368..13636
FT                      /vntifkey="4"
FT                      /label=ORF\6
FT                      /note="orf6"
FT      CDS             12128..12391
FT                      /vntifkey="4"
FT                      /label=ORF\5
FT                      /note="orf5"
FT      CDS             11400..12098
FT                      /vntifkey="4"
FT                      /label=ORF\4
FT                      /note="orf4 Integrase/Recombinase Similar to Site-specific
recombinase of Bacillus thuringiensis serovar israelensis ATCC 35646"
FT      CDS             complement(10310..11074)
FT                      /vntifkey="4"
FT                      /label=ORF\3
FT                      /note="orf3"
FT      CDS             9865..10050
FT                      /vntifkey="4"
FT                      /label=ORF\2
FT                      /note="orf2"
FT      rep_origin      complement(9165..9192)
FT                      /label=Rep_Origin_1
FT                      /note="potential rep origin; match pNostoc (Acc# M61381) nick
site (355-375), on reverse strand"
FT      misc_feature    9405..9458
FT                      /vntifkey="21"
FT                      /label=Rep\motif
FT                      /note="Rep protein active site motig EKXMYKVKXXD"
FT      CDS             6648..9638
FT                      /label=ORF\1
FT                      /note="orf1  rep ori binding protein slr7037 homolog Similar to
hypothetical protein slr7037 of plasmid pSYSA (103 kb)  of Synechocystis sp. PCC 6803"
FT      primer_bind     complement(5432..5463)
FT                      /label=Scm-F
FT      primer_bind     5116..5145
FT                      /vntifkey="28"
FT                      /label=Scm-R
FT      rep_origin      complement(5069..6127)
FT                      /label=OriVT
FT      promoter        2274..2342
FT                      /label=PrbcL*(optRBS)
FT                      /note="improved version of rbcL promoter from PCC6803"
FT      CDS             503..2201
FT                      /label=zmPDC(opti)
FT      CDS             complement(69..392)
FT                      /label=smtB
FT                      /note="smtB gene from Synechococcus PCC7002"
FT      promoter        333..494
FT                      /vntifkey="30"
FT                      /label=PsmtB*2
FT                      /note="improved version of the smtB promoter from PCC7002"
SQ      Sequence 12973 BP; 3975 A; 2324 C; 2561 G; 4113 T;
```

```
FT                    /label=Bcm-F
FT      CDS           6433..9618
FT                    /vntifkey="4"
FT                    /label=ORF\1
FT                    /note="orf1  rep ori binding protein slr7037 homolog Similar to
hypothetical protein slr7037 of plasmid pSYSA (103 kb)  of Synechocystis sp. PCC 6803"
FT      misc_feature  9214..9247
FT                    /vntifkey="21"
FT                    /label=Rep\motif
FT                    /note="Rep protein active site motiq EKKKYKVKKXD"
FT      rep_origin    complement(8954..8971)
FT                    /vntifkey="33"
FT                    /label=Rep_Origin_1
FT                    /note="potential rep origin; match pRostoc (Acc# N81351) nick
site (356-375); on reverse strand"
FT      CDS           9654..9833
FT                    /vntifkey="4"
FT                    /label=ORF\2
FT                    /note="orf2"
FT      CDS           complement(10899..10363)
FT                    /vntifkey="4"
FT                    /label=ORF\3
FT                    /note="orf3"
FT      CDS           11189..11875
FT                    /vntifkey="4"
FT                    /label=ORF\4
FT                    /note="orf4 Integrase/Recombinase Similar to Site-specific
recombinase of Bacillus thuringiensis serovar israelensis ATCC 35646"
FT      CDS           11917..12180
FT                    /vntifkey="4"
FT                    /label=ORF\5
FT                    /note="orf5"
FT      CDS           12177..12425
FT                    /vntifkey="4"
FT                    /label=ORF\6
FT                    /note="orf6"
FT      misc_marker   3800..4615
FT                    /vntifkey="22"
FT                    /label=Km**
FT                    /note="Km**"
FT      promoter      3335..3798
FT                    /vntifkey="30"
FT                    /label=PrbcAS1Cyano1
FT      terminator    3143..3298
FT                    /vntifkey="43"
FT                    /label=TrbcSAS1Cyano1
FT      CDS           2132..3139
FT                    /vntifkey="4"
FT                    /label=synADHAS1Cyano1(opt1)
FT      gene          2132..3142
FT                    /vntifkey="60"
FT                    /note="ADH"
FT      insertion_seq 2017..2062
FT                    /vntifkey="14"
FT                    /label=dsrA
FT                    /note="dsr terminator from E.coli"
FT      CDS           254..1990
FT                    /vntifkey="4"
FT                    /label=xwPDCAS1Cyano1(opt1)
SQ      Sequence 12762 BP; 3959 A; 2243 C; 2488 G; 4079 t;
```

```
Porf0316 copper-responsive ABICyano1 promoter
tggtcaagttactatatgtttagaaacaacaaaaaagaagtcattataaaaataattgatacaggaat
tggcattaataaagaagaacaaaaattaattttaatcgtttttatcgaatcaataaagcaagaaatag
agagaaaggcagttgcggattaggtttagctattgcaaatgcgatcgcgcttaatcatggtggtagaat
aattttagaaagtcaagaaaatcaaggcagtattttaccgtttatttaccgaaaaTCATTTCATccTA
ATTTCAtattcttttgaCAGAATcaaaggtAaagataaaaAGAGAGaaacagtcATG
PpetJ (Porf3461) copper-deprivation responsive ABICyano1 promoter
gttatatataaactcgaataaaattatcaatataaagtcaaactatatctatcctatttaactgctat
tggtaagtcccttaattagtgttggggtgaatagattttaaaagggcaaaccccccctttatcctccctc
gagagggggggagggcaaaaggcaaggggcaaggg aaaaattaagaattaagaattaaaaactccgaaca
cctgtaggggcgaatagccattcgcttccctcatccccccatctccccaacaccctaagcccctactc
gttactcatttatttacatcatttatttacatcattaagaaaagtaacaaattttgacaagtagtcttt
tgacaggaaaaagcaaattctcGAAGATgaaaacAatagaaaaaaattcaatcttacagtaacgatgaa
aaaactttTTAGGCttaattTTG
Porf3126 (PsmtA-like) zinc-responsive ABICyano1 promoter
ccaatatcttgtcatacatacttatttgcctcactattagccctatatgtctctattgtattttctt
ttctcctattcctagatcttgtaatgaatcattactctctgaaatatagctactaatttatggttgtt
tgtaaaatatattAACAAATGAAcaataaATCATATTTTgtgtTAATCTaattattAgacAACTACTGA
AtttataTTCAGATATTcacagataGGGAGAattttgattATG
PmntC (Porf1071) zinc/manganese-responsive ABICyano1 promoter
attctgtgaattgattagatttgaggttttttaagaggttgattaccttgcctccaaaaaaatcataac
acactaatgctctatatgaaagggctttagacccataggttttttgagaaaaaaacttgctaactctcgg
acaatgtcagcataactaaagtcaattcttttcgtactttataattgtctataatttaatatacaactg
ttctgaaactagttttttctctacattccttagttttatctgagtaaggttgcttgtaacttaacttcgg
ttgggcctaaaaatatccgattaggagcaggtgtcagactttaattaattattaattattaattgctta
ttgccaaccctcggcgacaccacttttttcatcagccccagataaagattgatgttttagttttgtttct
ttttatccctaattcaactaatacaagTAAAACtaaggttGtttatcaaaaatgatggttgatgtttg
ggtaaattttaagatattatgaaaagaaaatgaataaaaAATGAAaaatctttATG
Color code:
putative operator region
Pribnow-box (-10 region)
transcription start point
putative ribosomal binding site
start codon
```

FIG. 51

```
FT   rep_origin      complement(9130..9147)
FT                   /vntifkey="33"
FT                   /label=Rep_Origin_1
FT                   /note="potential rep origin; match pNostoc (Acc# 881361) nick
site (356-375); on reserse strand"
FT   CDS             9830..10015
FT                   /vntifkey="4"
FT                   /label=ORF\2
FT                   /note="orf2"
FT   CDS             complement(10275..11039)
FT                   /vntifkey="4"
FT                   /label=ORF\3
FT                   /note="orf3"
FT   CDS             11365..12861
FT                   /vntifkey="4"
FT                   /label=ORF\4
FT                   /note="orf4 Integrase/Recombinase Similar to Site-specific
recombinase of Bacillus thuringiensis serovar israelensis ATCC 35646"
FT   CDS             12093..12356
FT                   /vntifkey="4"
FT                   /label=ORF\5
FT                   /note="orf5"
FT   CDS             12353..12601
FT                   /vntifkey="4"
FT                   /label=ORF\6
FT                   /note="orf6"
FT   CDS             3976..4791
FT                   /vntifkey="4"
FT                   /label=Km**
FT                   /note="Km**"
FT   promoter        3811..3974
FT                   /vntifkey="30"
FT                   /label=PrbcL
FT   promoter        2321..2389
FT                   /vntifkey="30"
FT                   /label=Prbc*(optRBS)
FT   insertion_seq   2275..2320
FT                   /vntifkey="14"
FT                   /label=dsrA\ter
FT   terminator      3425..3470
FT                   /vntifkey="43"
FT                   /label=ter
FT                   /note="terminator taken from Tuo's "opt3" design"
FT   CDS             2390..3406
FT                   /vntifkey="4"
FT                   /label=AdhIII(opt)
FT                   /note="codon optimized for ABCC171"
FT   promoter        6..541
FT                   /vntifkey="30"
FT                   /label=PmntC
SQ   Sequence 12938 BP; 4063 A; 2273 C; 2513 G; 4066 T;
```

FIG. 52 (continued)

```
FT                      /vntifkey="33"
FT                      /label=Rep_Origin_1
FT                      /note="potential rep origin; match pNostoc (Acc# M61381) nick
site (358-375); on reverse strand"
FT   CDS                9614..9799
FT                      /vntifkey="4"
FT                      /label=ORF\2
FT                      /note="orf2"
FT   CDS                complement(10059..10823)
FT                      /vntifkey="4"
FT                      /label=ORF\3
FT                      /note="orf3"
FT   CDS                11149..11835
FT                      /vntifkey="4"
FT                      /label=ORF\4
FT                      /note="orf4 Integrase/Recombinase Similar to Site-specific
recombinase of Bacillus thuringiensis serovar israelensis ATCC 35646"
FT   CDS                11877..12140
FT                      /vntifkey="4"
FT                      /label=ORF\5
FT                      /note="orf5"
FT   CDS                12137..12386
FT                      /vntifkey="4"
FT                      /label=ORF\6
FT                      /note="orf6"
FT   CDS                3760..4575
FT                      /vntifkey="4"
FT                      /label=Km**
FT                      /note="Km**"
FT   promoter           3285..3750
FT                      /vntifkey="30"
FT                      /label=PrbcL
FT                      /promoter          2105..2173
FT                      /vntifkey="30"
FT                      /label=Prbc*(optRBS)
FT   insertion_seq      2059..2104
FT                      /vntifkey="14"
FT                      /label=dsrA\tex
FT   terminator         3209..3254
FT                      /vntifkey="43"
FT                      /label=ter
FT                      /note="terminator taken from Tuo's "opt3" design"
FT   CDS                2174..3190
FT                      /vntifkey="4"
FT                      /label=AdhI11(opt)
FT                      /note="codon optimized for ATCC171"
FT   promoter           6..329
FT                      /vntifkey="30"
FT                      /label=Porf0221
SQ   Sequence 12722 BP; 3998 A; 2244 C; 2486 G; 3994 t;
```

FIG. 53 (continued)

```
FT                      /vntifkey="33"
FT                      /label=Rep_Origin_1
FT                      /note="potential rep origin; match pNostoc (Acc# M613B1) nick
site (353-375) on reverse strand"
FT      CDS             9624..9809
FT                      /vntifkey="4"
FT                      /label=ORF\2
FT                      /note="orf2"
FT      CDS             complement(10069..10833)
FT                      /vntifkey="4"
FT                      /label=ORF\3
FT                      /note="orf3"
FT      CDS             11159..11845
FT                      /vntifkey="4"
FT                      /label=ORF\4
FT                      /note="orf4 Integrase/Recombinase Similar to Site-specific
recombinase of Bacillus thuringiensis serovar israelensis ATCC 35646"
FT      CDS             11867..12159
FT                      /vntifkey="4"
FT                      /label=ORF\5
FT                      /note="orf5"
FT      CDS             12187..12395
FT                      /vntifkey="4"
FT                      /label=ORF\6
FT                      /note="orf6"
FT      CDS             3770..4595
FT                      /vntifkey="4"
FT                      /label=Km**
FT                      /note="Km**"
FT      promoter        3365..3769
FT                      /vntifkey="30"
FT                      /label=PxbcL
FT      promoter        2115..2183
FT                      /vntifkey="30"
FT                      /label=Pxbc*(optRBS)
FT      insertion_seq   2069..2114
FT                      /vntifkey="14"
FT                      /label=dsrA\ter
FT      terminator      3219..3264
FT                      /vntifkey="43"
FT                      /label=ter
FT                      /note="terminator taken from Tuo's "opt3" design"
FT      CDS             2184..3200
FT                      /vntifkey="4"
FT                      /label=AdhIII(opt)
FT                      /note="codon optimized for ABCC171"
FT      promoter        6..335
FT                      /vntifkey="30"
FT                      /label=Porf0316
SQ      Sequence 12732 BP; 4027 A; 2229 C; 2488 G; 3988 t
```

FIG. 54 (continued)

```
FT                      /vntifkey="33"
FT                      /label=Rep_Origin_1
FT                      /note="potential rep origin; match pNestor (Acc# N61381) nick
site (359-375), on reverse strand"
FT    CDS               9658..9843
FT                      /vntifkey="4"
FT                      /label=ORF\2
FT                      /note="orf2"
FT    CDS               complement(10103..10867)
FT                      /vntifkey="4"
FT                      /label=ORF\3
FT                      /note="orf3"
FT    CDS               11193..11879
FT                      /vntifkey="4"
FT                      /label=ORF\4
FT                      /note="orf4 Integrase/Recombinase Similar to Site-specific
recombinase of Bacillus thuringiensis serovar israelensis ATCC 35646"
FT    CDS               11921..12184
FT                      /vntifkey="4"
FT                      /label=ORF\5
FT                      /note="orf5"
FT    CDS               12181..12429
FT                      /vntifkey="4"
FT                      /label=ORF\6
FT                      /note="orf6"
FT    CDS               3804..4619
FT                      /vntifkey="4"
FT                      /label=Km*
FT                      /note="Km**"
FT    promoter          3339..3802
FT                      /vntifkey="30"
FT                      /label=PrbcL
FT    promoter          2149..2217
FT                      /vntifkey="30"
FT                      /label=Prbc*(optRBS)
FT    insertion_seq     2103..2148
FT                      /vntifkey="14"
FT                      /label=dsrA\ter
FT    terminator        3253..3298
FT                      /vntifkey="43"
FT                      /label=ter
FT                      /note="terminator taken from Tuo's "opt3" design"
FT    CDS               2218..3234
FT                      /vntifkey="4"
FT                      /label=Adh111(opt)
FT                      /note="codon optimized for ABCC171"
FT    promoter          6..369
FT                      /vntifkey="30"
FT                      /label=PsigB
SQ    Sequence 12786 BP; 4097 A; 2252 C; 2493 G; 4014 t
```

FIG. 55 (continued)

```
FT                      /vntifkey="33"
FT                      /label=Rep_Origin_1
FT                      /note="potential rep origin; match pNostoc (Acc# X91361) nick
site (359-375); on reverse strand"
FT      CDS             9706..9891
FT                      /vntifkey="4"
FT                      /label=ORF\2
FT                      /note="orf2"
FT      CDS             complement(10151..10915)
FT                      /vntifkey="4"
FT                      /label=ORF\3
FT                      /note="orf3"
FT      CDS             11241..11927
FT                      /vntifkey="4"
FT                      /label=ORF\4
FT                      /note="orf4 Integrase/Recombinase Similar to Site-specific
recombinase of Bacillus thuringiensis serovar israelensis ATCC 35646"
FT      CDS             11969..12232
FT                      /vntifkey="4"
FT                      /label=ORF\5
FT                      /note="orf5"
FT      CDS             12229..12477
FT                      /vntifkey="4"
FT                      /label=ORF\6
FT                      /note="orf6"
FT      CDS             3852..4667
FT                      /vntifkey="4"
FT                      /label=Km**
FT                      /note="Km**"
FT      promoter        3887..3850
FT                      /vntifkey="30"
FT                      /label=Prbcb
FT      promoter        2197..2265
FT                      /vntifkey="30"
FT                      /label=Prbc*(optRBS)
FT      insertion_seq   2151..2196
FT                      /vntifkey="14"
FT                      /label=dsrA\ter
FT      terminator      3301..3345
FT                      /vntifkey="43"
FT                      /label=ter
FT                      /note="terminator taken from Tuo's "opt2" design"
FT      CDS             2266..3282
FT                      /vntifkey="4"
FT                      /label=Adh111(opt)
FT                      /note="codon optimized for A6lCyano1"
FT      promoter        6..817
FT                      /vntifkey="30"
FT                      /label=Porf1542
SQ      Sequence 12814 BP; 4042 A; 2245 C; 2499 G; 4028 t
```

FIG. 56 (continued)

```
FT   rep_origin      complement(6840..6857)
FT                   /vntifkey="33"
FT                   /label=Rep_Origin_1
FT                   /note="potential rep origin; match pBestec (Acc# 881361) nick
site (358-375); on reverse strand"
FT   CDS             9540..9725
FT                   /vntifkey="4"
FT                   /label=ORF\2
FT                   /note="orf2"
FT   CDS             complement(9985..10749)
FT                   /vntifkey="4"
FT                   /label=ORF\3
FT                   /note="orf3"
FT   CDS             11075..11761
FT                   /vntifkey="4"
FT                   /label=ORF\4
FT                   /note="orf4 Integrase/Recombinase Similar to Site-specific
recombinase of Bacillus thuringiensis serovar israelensis ATCC 35646"
FT   CDS             11803..12066
FT                   /vntifkey="4"
FT                   /label=ORF\5
FT                   /note="orf5"
FT   CDS             12063..12311
FT                   /vntifkey="4"
FT                   /label=ORF\6
FT                   /note="orf6"
FT   CDS             3686..4501
FT                   /vntifkey="4"
FT                   /label=Km**
FT                   /note="Km**"
FT   promoter        3221..3664
FT                   /vntifkey="30"
FT                   /label=PrbcL
FT   promoter        2031..2099
FT                   /vntifkey="30"
FT                   /label=Pskr*(optRBS)
FT   insertion_seq   1985..2030
FT                   /vntifkey="14"
FT                   /label=derA\ter
FT   terminator      3135..3180
FT                   /vntifkey="43"
FT                   /label=ter
FT                   /note="terminator taken from Tuo's "opt3" design"
FT   CDS             2100..3116
FT                   /vntifkey="4"
FT                   /label=AdhI1l(opt)
FT                   /note="codon optimized for ABCC171"
FT   promoter        6..251
FT                   /vntifkey="30"
FT                   /label=Porf3126
SQ   Sequence 10640 BP; 3967 A; 2229 C; 2456 G; 3996 t;
```

FIG. 57 (continued)

```
FT                      /label=Km**
FT                      /note="Km***"
FT      CDS             12126..12374
FT                      /vntifkey="4"
FT                      /label=ORF\6
FT                      /note="orf6"
FT      CDS             11846..12129
FT                      /vntifkey="4"
FT                      /label=ORF\5
FT                      /note="orf5"
FT      CDS             11138..11824
FT                      /vntifkey="4"
FT                      /label=ORF\4
FT                      /note="orf4 Integrase/Recombinase Similar to Site-specific
recombinase of Bacillus thuringiensis serovar israelensis ATCC 35646"
FT      CDS             complement(10048..10812)
FT                      /vntifkey="4"
FT                      /label=ORF\3
FT                      /note="orf3"
FT      CDS             9603..9738
FT                      /vntifkey="4"
FT                      /label=ORF\2
FT                      /note="orf2"
FT      rep_origin      complement(8903..8920)
FT                      /vntifkey="33"
FT                      /label=Rep_Origin_1
FT                      /note="potential rep origin; match pSbostoc (Acc# N81361) nick
site (356-375); on reverse strand"
FT      misc_feature    9163..9196
FT                      /vntifkey="21"
FT                      /label=Rep\motif
FT                      /note="Rep protein active site motif EXXKYXYKXXD"
FT      CDS             6382..9567
FT                      /vntifkey="4"
FT                      /label=ORF\1
FT                      /note="orf1  rep ori binding protein slr7037 homolog Similar to
hypothetical protein slr7037 of plasmid pSYSA (103 kb)  of Synechocystis sp. PCC 6803"
FT      primer_bind     complement(5170..5201)
FT                      /vntifkey="28"
FT                      /label=Bom-F
FT      primer_bind     4852..4883
FT                      /vntifkey="28"
FT                      /label=Bom-R
FT      rep_origin      complement(4807..5865)
FT                      /vntifkey="33"
FT                      /label=OriVT
FT      CDS             315..2024
FT                      /vntifkey="4"
FT                      /label=PDC(opt1)
SQ      Sequence 12711 BP; 3999 A; 2238 C; 2475 G; 4008 T;
```

FIG. 58 (continued)

| Construct | IntegSite | Homology length | Marker | FRT sites | Promoter | # of clones | PCR verified | # of double crossovers |
|---|---|---|---|---|---|---|---|---|
| TK539 | flv3 | 2 kb | Km | - | PrbcL | 23 | 15 | 1 |
| TK541 | flv3 | 2 kb | Gm | - | PrbcL | >100 | 15 | 0 |
| TK552 | flv3 | 2 kb | Gm | - | PcpcB | >200 | 16 | 2 |
| TK617 | flv3 | 1 kb | Gm | x | PcpcB | 0 | 0 | 0 |
| TK618 | flv3 | 2 kb | Gm | x | PcpcB | 4 | 4 | 0 |
| TK619 | flv3 | 3 kb | Gm | x | PcpcB | 33 | 33 | 27 |
| TK572 | recJ | 2.5 kb | Gm | x | PcpcB | 1 | 1 | 1 |
| TK567 | recJ2 | 2.5 kb | Gm | x | PcpcB | 9 | 9 | 2 |

FIG. 104

```
FT   rep_origin      complement(6545..6603)
FT                   /vntifkey="33"
FT                   /label=OriVT
FT   CDS             7128..10306
FT                   /vntifkey="4"
FT                   /label=ORF\1
FT                   /note="orf1 rep ori binding protein slr7037 Homolog Similar to
hypothetical protein slr7037 of plasmid pCYSA (103 kb) of Synechocystis sp. PCC 6803"
FT   CDS             10341..10526
FT                   /vntifkey="4"
FT                   /label=ORF\2
FT                   /note="orf2"
FT   CDS             complement(10786..11050)
FT                   /vntifkey="4"
FT                   /label=ORF\3
FT                   /note="orf3"
FT   CDS             11076..12562
FT                   /vntifkey="4"
FT                   /label=ORF\4
FT                   /note="orf4 Integrase/Recombinase Similar to Site-specific
recombinase of Bacillus thuringiensis serovar israelensis ATCC 35646"
FT   CDS             12604..12867
FT                   /vntifkey="4"
FT                   /label=ORF\5
FT                   /note="orf5"
FT   CDS             12864..13112
FT                   /vntifkey="4"
FT                   /label=ORF\6
FT                   /note="orf6"
FT   3'UTR           4649..5422
FT                   /vntifkey="56"
FT                   /label=pilT-flank
FT   3'UTR           2193..2972
FT                   /vntifkey="56"
FT                   /label=pilC-flank
FT   promoter        complement(3924..4363)
FT                   /vntifkey="30"
FT                   /label=PrbcLAMICyano
FT   CDS             complement(3198..3923)
FT                   /vntifkey="4"
FT                   /label=Km**
FT   promoter        101..563
FT                   /vntifkey="30"
FT                   /label=PsacB
FT   CDS             564..1985
FT                   /vntifkey="4"
FT                   /label=sacB
SQ   Sequence 13354 BP; 4435 A; 2630 C; 2459 G; 3830 t;
```

FIG. 105 (continued)

```
FT   CDS            9156..9172
FT                  /ntifkey="4"
FT                  /label=ADX111
FT                  /note="codon optimized for A&tCyano1"
FT   promoter       5899..6309
FT                  /ntifkey="30"
FT                  /label=Porf8223
FT   CDS            6311..8014
FT                  /ntifkey="4"
FT                  /label=cmFDCA&tCyano1(opt1)
SQ   Sequence 9189 BP; 2836 A; 1605 C; 1873 G; 2875 T;
```

FIG. 108 (continued)

| Construct | Integ site | Homology length Introduced genes | Marker | FRT sites | Promoter | # of clones | PCR verified | # of double crossovers |
|---|---|---|---|---|---|---|---|---|
| Knockouts: | | | | | | | | |
| TK596 | narB | 2 kb | Gm | x | PcpcB | 6 | 6 | 5 |
| TK597 | argH | 2 kb | Gm | x | PcpcB | 1 | 1 | 1 |
| TK598 | leuB | 2 kb | Gm | x | PcpcB | 1 | 1 | 1 |
| TK616 | ycf37 | 2 kb | Gm | x | PcpcB | 5 | 5 | 3 |
| Gene introductions: | | | | | | | | |
| #1817 | flv3 | 2 kb, P$_{nirA}$-pdc/adh | Gm | - | PrbcL | 1 | 1 | 0 |
| #1818 | flv3 | 2 kb, P$_{nrsBA}$-pdc/adh | Gm | - | PrbcL | 3 | 2 | 0 |
| #1819 | flv3 | 2 kb, P$_{nirA}$-pdc/adh | Gm | - | PcpcB | 1 | 1 | 0 |
| #1820 | flv3 | 2 kb, P$_{nrsBA}$-pdc/adh | Gm | - | PcpcB | 1 | 1 | 0 |

FIG. 113

PCR segregation (primer I255/I256)
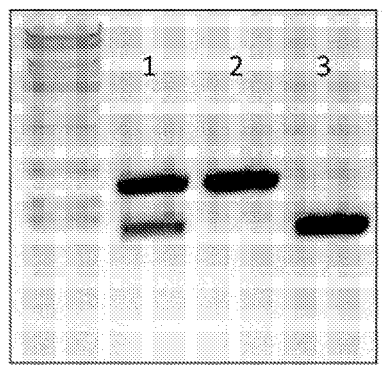
Lane 1: ABICyano1::TK616.4
Lane 2: ABICyano1::TK616.5
Lane 3: ABICyano1 wild type
PCR control: ycf37 detection (primer I269/I270)
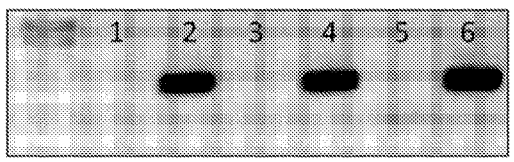
Lane 1-5: ABICyano1::TK616 clones 1-5
Lane 6: ABICyano1 wild type
FIG. 115

PCR ΔargH segregation (TK597)
ABICyano1 ::TK597    ABICyano1 wild type
Growth test of AB1 ΔargH (1a, 1b, 1c vs. wild type) on BG11 plates
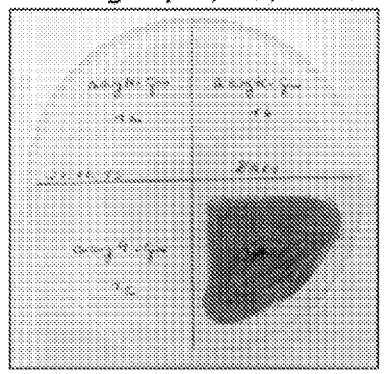
FIG. 116

```
                  putative operator        -10 region                                                    RBS
Porf0221   tcattcatcctcattcatttcctgtcaccatggtatggaagattagtgaagaaaatgaggaaaagtttattatg
Porf0223   tcttttcatagtgattcataattgataagtacaataacgattattattagtaaaagattttcaaatcatg
Porf0316   tcattcatcctaattcatatctctttgacagaatcaaaggtaaagataaaagagagaaacagtcatg
optimized RBS                                                          aaGGAGGATCAGCCTTATG Copper-promoter variants with improved RBS:
Porf0221*  tcattcatcctcattcatttcctgtcaccatggtatggaagattagtgaaaatAaggaGgaTCAGCCATATG Porf0223*  tcttttcatagtgattcataattgataagtacaataacgattattattagtaaGGagGATCAGCCATATG Porf0316*  tcattcatcctaattcatatctctttgacagaatcaaaggtaaagataaaaGgagGATCAGCCATATG
```

FIG. 121

```
                 putative operator          -10 region                                RBS
Porf0221 tcatttcatctcattcatttcatattctcctgtcaccatgtatggaagattaggtaaaaatgaggaaaagtttattATG
Porf0223 tctcttcatagtgattcataattgatagtagtttcatgatttcatgatagataggtaaaangattcaaatcATG
Porf0316 tcatttcatctcataattcatattcttttgacagaatcaaaggtcaaaggtaaaangagaagaaacagtcATG
consensus -10 region                TATAAT
```

```
Copper-promoter variants with improved -10 region:
                 putative operator          -10 region                                RBS
Porf0221 tcatttcatctcattcatttcatattctcctgtTaccatgtatggaagattaggtaaaaatgaggaaaagtttattATG
Porf0223 tctcttcatagtgattcataattgatagtaTaataacgattattttagtaaaangattcaaatcATG
Porf0316 tcatttcatctcaattcatattcttttgaTagaaTcaaaggtcaaaggtaaaangagaagaaacagtcATG
```

FIG. 122

```
FT                      /label=ORF\1
FT                      /note="orf1  rep ori binding protein slr7037 homolog Similar to
hypothetical protein slr7037 of plasmid pSYSA (103 kb)  of Synechocystis sp. PCC 6803"
FT     misc_feature     9132..9165
FT                      /vntifkey="21"
FT                      /label=Rep\motif
FT                      /note="Rep protein active site motif EKXY/XVKXXP"
FT     rep_origin       complement(5872..8889)
FT                      /vntifkey="33"
FT                      /label=Rep_Origin_1
FT                      /note="potential rep origin; match pMostot (Acc# M81381) nick
site (358-375); on reverse strand"
FT     CDS              9572..9757
FT                      /vntifkey="4"
FT                      /label=ORF\2
FT                      /note="orf2"
FT     CDS              complement(10017..10701)
FT                      /vntifkey="4"
FT                      /label=ORF\3
FT                      /note="orf3"
FT     CDS              11107..11793
FT                      /vntifkey="4"
FT                      /label=ORF\4
FT                      /note="orf4 Integrase/Recombinase Similar to Site-specific
recombinase of Bacillus thuringiensis serovar israelensis ATCC 35646"
FT     CDS              11835..12098
FT                      /vntifkey="4"
FT                      /label=ORF\5
FT                      /note="orf5"
FT     CDS              12095..12343
FT                      /vntifkey="4"
FT                      /label=ORF\6
FT                      /note="orf6"
FT     CDS              3718..4533
FT                      /vntifkey="4"
FT                      /label=Km***
FT                      /note="Km***"
FT     promoter         3252..3716
FT                      /vntifkey="30"
FT                      /label=PrkcL
FT     promoter         2063..2131
FT                      /vntifkey="30"
FT                      /label=Psbc*(optRBS)
FT     insertion_seq    2017..2062
FT                      /vntifkey="14"
FT                      /label=dsrA\ter
FT     terminator       3167..3212
FT                      /vntifkey="43"
FT                      /label=ter
FT                      /note="terminator taken from Tuo's "opt3" design"
FT     CDS              2131..3148
FT                      /vntifkey="4"
FT                      /label=Adh\II(opt)
FT                      /note="codon optimized for ABICyano1"
SQ     Sequence 12680 BP; 3989 A; 2235 C; 2475 G; 3981 t;
```

FIG. 125 (continued)

```
FT                      /vntifkey="4"
FT                      /label=Km**
FT                      /note="Km**"
FT       CDS            11940..12108
FT                      /vntifkey="4"
FT                      /label=ORF\6
FT                      /note="orf6"
FT       CDS            11680..11943
FT                      /vntifkey="4"
FT                      /label=ORF\5
FT                      /note="orf5"
FT       CDS            10952..11638
FT                      /vntifkey="4"
FT                      /label=ORF\4
FT                      /note="orf4 Integrase/Recombinase Similar to Site-specific
recombinase of Bacillus thuringiensis serovar israelensis ATCC 35646"
FT       CDS            complement(9862..10626)
FT                      /vntifkey="4"
FT                      /label=ORF\3
FT                      /note="orf3"
FT       CDS            9417..9802
FT                      /vntifkey="4"
FT                      /label=ORF\2
FT                      /note="orf2"
FT       rep_origin     complement(8717..8734)
FT                      /vntifkey="33"
FT                      /label=Rep_Origin_1
FT                      /note="potential rep origin; match pNostoc (Acc# M81381) nick
site (358-378); on reverse strand"
FT       misc_feature   8977..9010
FT                      /vntifkey="21"
FT                      /label=Rep\motif
FT                      /note="Rep protein active site motig EKXEYKVKXXD"
FT       CDS            6196..9381
FT                      /vntifkey="4"
FT                      /label=ORF\1
FT                      /note="orf1 rep ori binding protein alr7037 homolog Similar to
hypothetical protein alr7037 of plasmid pCYSA (103 kb)  of Synechocystis sp. PCC 6803"
FT       primer_bind    complement(4984..5015)
FT                      /vntifkey="28"
FT                      /label=Bom-F
FT       primer_bind    4666..4697
FT                      /vntifkey="28"
FT                      /label=Bom-R
FT       rep_origin     complement(4621..5679)
FT                      /vntifkey="33"
FT                      /label=OriVT
FT       CDS            129..1835
FT                      /vntifkey="4"
FT                      /label=zmPDC(opt)
SQ       Sequence 12525 BP; 3935 A; 2203 C; 2448 G; 3939 T;
```

FIG. 126 (continued)

```
FT                      /vntifkey="28"
FT                      /label=Bom-F
FT      CDS             6349..9034
FT                      /vntifkey="4"
FT                      /label=ORF\1
FT                      /note="orf1  rep ori binding protein slr7037 homolog Similar to
hypothetical protein slr7037 of plasmid pSYSA (103 kb)  of Synechocystis sp. PCC 6803"
FT      misc_feature    9130..9163
FT                      /vntifkey="21"
FT                      /label=Rep\motif
FT                      /note="Rep protein active site motif SXXSYXVFXXD"
FT      rep_origin      complement(8070..8087)
FT                      /vntifkey="33"
FT                      /label=Rep_Origin_1
FT                      /note="potential rep origin; match pNostoc (Acc# M81381) nick
site (358-375); on reverse strand"
FT      CDS             9570..9755
FT                      /vntifkey="4"
FT                      /label=ORF\2
FT                      /note="orf2"
FT      CDS             complement(10015..10773)
FT                      /vntifkey="4"
FT                      /label=ORF\3
FT                      /note="orf3"
FT      CDS             11165..11791
FT                      /vntifkey="4"
FT                      /label=ORF\4
FT                      /note="orf4 Integrase/Recombinase Similar to Site-specific
recombinase of Bacillus thuringiensis serovar israelensis ATCC 35646"
FT      CDS             11833..12096
FT                      /vntifkey="4"
FT                      /label=ORF\5
FT                      /note="orf5"
FT      CDS             12093..12341
FT                      /vntifkey="4"
FT                      /label=ORF\6
FT                      /note="orf6"
FT      CDS             3716..4531
FT                      /vntifkey="4"
FT                      /label=Km**
FT                      /note="Km**"
FT      promoter        3251..3714
FT                      /vntifkey="30"
FT                      /label=PrbcL
FT      promoter        2063..2131
FT                      /vntifkey="30"
FT                      /label=Prbc* (optRBS)
SQ      Sequence 12678 BP; 3930 A; 2317 C; 2557 G; 3874 t;
```

FIG. 127 (continued)

```
FT                   /label=Bom-R
FT   primer_bind     complement(5142..5173)
FT                   /vntifkey="28"
FT                   /label=Bom-F
FT   CDS             6354..9539
FT                   /vntifkey="4"
FT                   /label=ORF\1
FT                   /note="orf1  rep ori binding protein slr7037 homolog Similar to
hypothetical protein slr7037 of plasmid pSYSA (103 kb)  of Synechocystis sp. PCC 6803"
FT   misc_feature    9135..9168
FT                   /vntifkey="21"
FT                   /label=Pep\motif
FT                   /note="Rep protein active site motif EXXKYYVKKKC"
FT   rep_origin      complement(8875..8892)
FT                   /vntifkey="33"
FT                   /label=Rep_Origin_1
FT                   /note="potential rep origin; match pNostoc (Acc# M81381) nick
site (358-375); on reverse strand"
FT   CDS             9575..9760
FT                   /vntifkey="4"
FT                   /label=ORF\2
FT                   /note="orf2"
FT   CDS             complement(10020..10784)
FT                   /vntifkey="4"
FT                   /label=ORF\3
FT                   /note="orf3"
FT   CDS             11110..11796
FT                   /vntifkey="4"
FT                   /label=ORF\4
FT                   /note="orf4 Integrase/Recombinase Similar to Site-specific
recombinase of Bacillus thuringiensis serovar israelensis ATCC 35646"
FT   CDS             11838..12101
FT                   /vntifkey="4"
FT                   /label=ORF\5
FT                   /note="orf5"
FT   CDS             12098..12346
FT                   /vntifkey="4"
FT                   /label=ORF\6
FT                   /note="orf6"
FT   CDS             3731..4535
FT                   /vntifkey="4"
FT                   /label=Kmr
FT                   /note="Kmr**"
FT   promoter        3256..3719
FT                   /vntifkey="30"
FT                   /label=PrbcL
SQ   Sequence 12683 BP; 3982 A; 2246 C; 2471 G; 3984 t;
```

FIG. 128 (continued)

```
FT   primer_bind    4631..4855
FT                  /vntifkey="28"
FT                  /label=Som-R
FT   primer_bind    complement(5142..5173)
FT                  /vntifkey="28"
FT                  /label=Som-F
FT   CDS            6354..9539
FT                  /vntifkey="4"
FT                  /label=ORF\1
FT                  /note="orf1  rep ori binding protein slr7037 homolog Similar to
hypothetical protein slr7037 of plasmid pSYSA (103 kb)  of Synechocystis sp. PCC 6803"
FT   misc_feature   9135..9168
FT                  /vntifkey="21"
FT                  /label=Rep\motif
FT                  /note="Rep protein active site motif EXXKYXVKKKD"
FT   rep_origin     complement(8875..8892)
FT                  /vntifkey="33"
FT                  /label=Rep_Origin_1
FT                  /note="potential rep origin; match pNostoc (Acc# M81381) nick
site (358-375); on reverse strand"
FT   CDS            9575..9760
FT                  /vntifkey="4"
FT                  /label=ORF\2
FT                  /note="orf2"
FT   CDS            complement(10020..10784)
FT                  /vntifkey="4"
FT                  /label=ORF\3
FT                  /note="orf3"
FT   CDS            11110..11796
FT                  /vntifkey="4"
FT                  /label=ORF\4
FT                  /note="orf4 Integrase/Recombinase Similar to Site-specific
recombinase of Bacillus thuringiensis serovar israelensis ATCC 35646"
FT   CDS            11839..12101
FT                  /vntifkey="4"
FT                  /label=ORF\5
FT                  /note="orf5"
FT   CDS            12098..12346
FT                  /vntifkey="4"
FT                  /label=ORF\6
FT                  /note="orf6"
FT   CDS            3721..4536
FT                  /vntifkey="4"
FT                  /label=Km**
FT                  /note="Km**"
FT   promoter       3256..3719
FT                  /vntifkey="30"
FT                  /label=PrbcL
SQ   Sequence 12683 BP; 3965 A; 2263 C; 2512 G; 3939 T;
```

FIG. 129 (continued)

```
FT                      /vntifkey="4"
FT                      /label=ORF\3
FT                      /note="orf3"
FT      CDS             9590..9775
FT                      /vntifkey="4"
FT                      /label=ORF\2
FT                      /note="orf2"
FT      rep_origin      complement(8890..8907)
FT                      /vntifkey="33"
FT                      /label=Rep_Origin_1
FT                      /note="potential rep origin; match pNostoc (Acc# M81381) nick
site (358-375), on reverse strand"
FT      misc_feature    9155..9183
FT                      /vntifkey="21"
FT                      /label=Rep\motif
FT                      /note="Rep protein active site motif EXXKYXVKXYD"
FT      CDS             6369..9554
FT                      /vntifkey="4"
FT                      /label=ORF\1
FT                      /note="orf1  rep ori binding protein slr7037 homolog Similar to
hypothetical protein slr7037 of plasmid pSYSA (103 kb)  of Synechocystis sp. PCC 6803"
FT      primer_bind     complement(5157..5188)
FT                      /vntifkey="28"
FT                      /label=Bom-F
FT      primer_bind     4839..4870
FT                      /vntifkey="28"
FT                      /label=Bom-R
FT      rep_origin      complement(4794..5052)
FT                      /vntifkey="33"
FT                      /label=OriVT
FT      promoter        1..383
FT                      /vntifkey="30"
FT                      /label=PolyA
FT      terminator      1998..2054
FT                      /vntifkey="43"
FT                      /label=dsrA
FT      promoter        2056..2173
FT                      /vntifkey="30"
FT                      /label=PrpsL*4
FT                      /note="modified version of endogenous rpsL promoter"
FT      CDS             2174..3184
FT                      /vntifkey="4"
FT                      /label=synADH
SQ      Sequence 12698 BP; 3998 A; 2332 C; 2560 G; 3848 T;
```

FIG. 130 (continued)

```
FT                     /label=ORF\6
FT                     /note="orf6"
FT      CDS            12246..12563
FT                     /vntifkey="4"
FT                     /label=ORF\5
FT                     /note="orf5"
FT      CDS            11512..12198
FT                     /vntifkey="4"
FT                     /label=ORF\4
FT                     /note="orf4 Integrase/Recombinase Similar to Site-specific
recombinase of Bacillus thuringiensis serovar israelensis ATCC 35646"
FT      CDS            complement(10422..11186)
FT                     /vntifkey="4"
FT                     /label=ORF\3
FT                     /note="orf3"
FT      CDS            9977..10160
FT                     /vntifkey="4"
FT                     /label=ORF\2
FT                     /note="orf2"
FT      rep_origin     complement(9277..9294)
FT                     /vntifkey="33"
FT                     /label=Rep_Origin_1
FT                     /note="potential rep origin; match pNostoc (Acc# NS1381) nick
site (358-375) on reserse strand"
FT      misc_feature   9537..9576
FT                     /vntifkey="21"
FT                     /label=Rep\motif
FT                     /note="Rep protein active site motif EYXKYEVKXXE"
FT      CDS            6796..9941
FT                     /vntifkey="4"
FT                     /label=ORF\1
FT                     /note="orf1  rep ori binding protein slr7037 homolog Similar to
hypothetical protein slr7037 of plasmid pSYSA (103 kb)  of Synechocystis sp. PCC 6803"
FT      primer_bind    complement(5544..5575)
FT                     /vntifkey="28"
FT                     /label=Kcm-F
FT      primer_bind    5226..5257
FT                     /vntifkey="28"
FT                     /label=Kcm-R
FT      rep_origin     complement(5181..6239)
FT                     /vntifkey="33"
FT                     /label=OriVT
FT      promoter       1..283
FT                     /vntifkey="30"
FT                     /label=PnirA
FT      terminator     1998..2054
FT                     /vntifkey="43"
FT                     /label=dsrA
SQ      Sequence 13065 BP; 1194 A; 3306 C; 2648 G; 4037 t;
```

FIG. 131 (continued)

```
FT                      /note="orf6"
FT      CDS             12237..12500
FT                      /vntifkey="4"
FT                      /label=ORF\5
FT                      /note="orf5"
FT      CDS             11569..12195
FT                      /vntifkey="4"
FT                      /label=ORF\4
FT                      /note="orf4 Integrase/Recombinase Similar to Site-specific
recombinase of Bacillus thuringiensis serovar israelensis ATCC 35646"
FT      CDS             complement(10419..11183)
FT                      /vntifkey="4"
FT                      /label=ORF\3
FT                      /note="orf3"
FT      CDS             9974..10159
FT                      /vntifkey="4"
FT                      /label=ORF\2
FT                      /note="orf2"
FT      rep_origin      complement(9274..9291)
FT                      /vntifkey="33"
FT                      /label=Rep_Origin_1
FT                      /note="potential rep origin; match pNostoc (Acc# M81381) nick
site (359-375); on reverse strand"
FT      misc_feature    9534..9567
FT                      /vntifkey="21"
FT                      /label=Rep\motif
FT                      /note="Rep protein active site motif EXXMYXVMXRD"
FT      CDS             6793..9938
FT                      /vntifkey="4"
FT                      /label=ORF\1
FT                      /note="orf1  rep ori binding protein slr7037 homolog Similar to
hypothetical protein slr7037 of plasmid pSYSA (103 kb)  of Synechocystis sp. PCC 6803"
FT      primer_bind     complement(5541..5572)
FT                      /vntifkey="28"
FT                      /label=Bom-F
FT      primer_bind     5223..5254
FT                      /vntifkey="28"
FT                      /label=Bom-R
FT      rep_origin      complement(5178..6236)
FT                      /vntifkey="33"
FT                      /label=OriVT
FT      promoter        1..283
FT                      /vntifkey="30"
FT                      /label=PnixA
FT      terminator      1998..2094
FT                      /vntifkey="43"
FT                      /label=dsrA
SQ      Sequence 13082 BP; 4201 A; 2295 C; 2552 G; 4034 T;
```

FIG. 132 (continued)

```
FT                      /note="orf6"
FT      CDS             12245..12503
FT                      /vntifkey="4"
FT                      /label=ORF\5
FT                      /note="orf5"
FT      CDS             11317..12203
FT                      /vntifkey="4"
FT                      /label=ORF\4
FT                      /note="orf4 Integrase/Recombinase Similar to Site-specific
recombinase of Bacillus thuringiensis serovar israelensis ATCC 35646"
FT      CDS             complement(10427..11191)
FT                      /vntifkey="4"
FT                      /label=ORF\3
FT                      /note="orf3"
FT      CDS             9981..10167
FT                      /vntifkey="4"
FT                      /label=ORF\2
FT                      /note="orf2"
FT      rep_origin      complement(9282..9299)
FT                      /vntifkey="33"
FT                      /label=Rep_Origin_1
FT                      /note="potential rep origin; match pNostoc (Acc# M81381) nick
site (358-375); on reverse strand"
FT      misc_feature    9562..9575
FT                      /vntifkey="21"
FT                      /label=Rep\motif
FT                      /note="Rep protein active site motif KXXKYKVKXXD"
FT      CDS             6761..9946
FT                      /vntifkey="4"
FT                      /label=ORF\1
FT                      /note="orf1 rep ori binding protein slr7037 homolog Similar to
hypothetical protein slr7037 of plasmid pSYSA (103 kb) of Synechocystis sp. PCC 6803"
FT      primer_bind     complement(5549..5580)
FT                      /vntifkey="28"
FT                      /label=Box-F
FT      primer_bind     5231..5262
FT                      /vntifkey="28"
FT                      /label=Box-B
FT      rep_origin      complement(5186..6244)
FT                      /vntifkey="33"
FT                      /label=OriVT
FT      promoter        1..283
FT                      /vntifkey="30"
FT                      /label=PnirA
FT      terminator      1994..2054
FT                      /vntifkey="43"
FT                      /label=dsrA
SQ      Sequence 13090 BP; 4128 A; 2375 C; 2621 G; 3966 T;
```

FIG. 133 (continued)

```
FT                      /note="orf6"
FT      CDS             12225..12488
FT                      /vntifkey="4"
FT                      /label=ORF\5
FT                      /note="orf5"
FT      CDS             11497..12133
FT                      /vntifkey="4"
FT                      /label=ORF\4
FT                      /note="orf4 Integrase/Recombinase Similar to Site-specific
recombinase of Bacillus thuringiensis serovar israelensis ATCC 35646"
FT      CDS             complement(10467..11171)
FT                      /vntifkey="4"
FT                      /label=ORF\3
FT                      /note="orf3"
FT      CDS             9362..10147
FT                      /vntifkey="4"
FT                      /label=ORF\2
FT                      /note="orf2"
FT      rep_origin      complement(9262..9279)
FT                      /vntifkey="33"
FT                      /label=Rep_Origin_1
FT                      /note="potential rep origin; match pNostoc (Accl #81381) nick
site (359-375); on reverse strand"
FT      misc_feature    9522..9555
FT                      /vntifkey="21"
FT                      /label=Rep\motif
FT                      /note="Rep protein active site motif EXYFYXVKXXD"
FT      CDS             6741..9926
FT                      /vntifkey="4"
FT                      /label=ORF\1
FT                      /note="orf1  rep ori binding protein slr7037 homolog Similar to
hypothetical protein slr7037 of plasmid pSYSA (103 kb)  of Synechocystis sp. PCC 6803"
FT      primer_bind     complement(5529..5560)
FT                      /vntifkey="28"
FT                      /label=Box-F
FT      primer_bind     5211..5242
FT                      /vntifkey="28"
FT                      /label=Box-R
FT      rep_origin      complement(5166..6234)
FT                      /vntifkey="33"
FT                      /label=OriVT
FT      promoter        1..283
FT                      /vntifkey="30"
FT                      /label=PnirA
FT      terminator      1998..2054
FT                      /vntifkey="43"
FT                      /label=dsrA
SQ      Sequence 13070 BP; 4192 A; 2311 C; 2532 G; 4035 t
```

FIG. 134 (continued)

```
FT                      /label=Bcm-R
FT      primer_bind     complement(5522..5583)
FT                      /vntifkey="28"
FT                      /label=Bcm-F
FT      CDS             6734..9819
FT                      /vntifkey="4"
FT                      /label=ORF\1
FT                      /note="orf1  rep ori binding protein slr7037 homolog Similar to
hypothetical protein slr7037 of plasmid pSYSA (103 kb)  of Synechocystis sp. PCC 6803"
FT      misc_feature    9515..9540
FT                      /vntifkey="21"
FT                      /label=Rep\motif
FT                      /note="Rep protein active site motif EKRKYKYKXXD"
FT      rep_origin      complement(9265..9272)
FT                      /vntifkey="33"
FT                      /label=Rep_Origin_1
FT                      /note="potential rep origin; match pBoster (Acc# M81381) nick
site (358-375); on reverse strand"
FT      CDS             9955..10140
FT                      /vntifkey="4"
FT                      /label=ORF\2
FT                      /note="orf2"
FT      CDS             complement(10400..11164)
FT                      /vntifkey="4"
FT                      /label=ORF\3
FT                      /note="orf3"
FT      CDS             11490..12176
FT                      /vntifkey="4"
FT                      /label=ORF\4
FT                      /note="orf4 Integrase/Recombinase Similar to Site-specific
recombinase of Bacillus thuringiensis serovar israelensis ATCC 35646"
FT      CDS             12213..12481
FT                      /vntifkey="4"
FT                      /label=ORF\5
FT                      /note="orf5"
FT      CDS             12478..12726
FT                      /vntifkey="4"
FT                      /label=ORF\6
FT                      /note="orf6"
FT      CDS             4101..4916
FT                      /vntifkey="4"
FT                      /label=Km**
FT                      /note="Km***"
FT      promoter        3636..4099
FT                      /vntifkey="30"
FT                      /label=PrkcL
SQ      Sequence 13063 BP; 4139 A; 2301 C; 2535 G; 4089 T;
```

FIG. 135 (continued)

```
FT                      /label=OriVT
FT      primer_bind     5240..5271
FT                      /vntifkey="28"
FT                      /label=Scm-R
FT      primer_bind     complement(5558..5589)
FT                      /vntifkey="28"
FT                      /label=Scm-F
FT      CDS             6770..9955
FT                      /vntifkey="4"
FT                      /label=ORF\1
FT                      /note="orf1  rep ori binding protein slr7037 homolog Similar to
hypothetical protein slr7037 of plasmid pSYSA (103 kb)  of Synechocystis sp. PCC 6803"
FT      misc_feature    9551..9584
FT                      /vntifkey="21"
FT                      /label=Pep\motif
FT                      /note="Rep protein active site motif EXXKYXVKXXD"
FT      rep_origin      complement(9291..9308)
FT                      /vntifkey="33"
FT                      /label=Rep_Origin_1
FT                      /note="potential rep origin; match pNostoc (Acc# M81381) nick
site (358-375); on reverse strand"
FT      CDS             9991..10176
FT                      /vntifkey="4"
FT                      /label=ORF\2
FT                      /note="orf2"
FT      CDS             complement(10436..11200)
FT                      /vntifkey="4"
FT                      /label=ORF\3
FT                      /note="orf3"
FT      CDS             11526..12212
FT                      /vntifkey="4"
FT                      /label=ORF\4
FT                      /note="orf4 Integrase/Recombinase Similar to Site-specific
recombinase of Bacillus thuringiensis serovar israelensis ATCC 35646"
FT      CDS             12254..12517
FT                      /vntifkey="4"
FT                      /label=ORF\5
FT                      /note="orf5"
FT      CDS             12514..12762
FT                      /vntifkey="4"
FT                      /label=ORF\6
FT                      /note="orf6"
FT      CDS             4137..4952
FT                      /vntifkey="4"
FT                      /label=Km**
FT                      /note="Km**"
FT      promoter        3672..4135
FT                      /vntifkey="30"
FT                      /label=Prbcl
SQ      Sequence 13099 BP; 4159 A; 2282 C; 2540 G; 4118 t
```

FIG. 136 (continued)

```
FT                      /label=Bom-F
FT        CDS           8654..9839
FT                      /vntifkey="4"
FT                      /label=ORF\1
FT                      /note="orf1  rep ori binding protein slr7037 homolog Similar to
hypothetical protein slr7037 of plasmid pSYSA (103 kb)  of Synechocystis sp. PCC 6803"
FT        misc_feature  9435..9462
FT                      /vntifkey="21"
FT                      /label=Rep\motif
FT                      /note="Rep protein active site motif EKXKYXVKXXD"
FT        rep_origin    complement(9175..9192)
FT                      /vntifkey="33"
FT                      /label=Rep_Origin_1
FT                      /note="potential rep origin; match pRostoc (Acc# N81381) nick
site (356-375); on reverse strand"
FT        CDS           9875..10060
FT                      /vntifkey="4"
FT                      /label=ORF\2
FT                      /note="orf2"
FT        CDS           complement(10320..11004)
FT                      /vntifkey="4"
FT                      /label=ORF\3
FT                      /note="orf3"
FT        CDS           11410..12096
FT                      /vntifkey="4"
FT                      /label=ORF\4
FT                      /note="orf4 integrase/Recombinase Similar to Site-specific
recombinase of Bacillus thuringiensis serovar israelensis ATCC 35646"
FT        CDS           12138..12401
FT                      /vntifkey="4"
FT                      /label=ORF\5
FT                      /note="orf5"
FT        CDS           12398..12646
FT                      /vntifkey="4"
FT                      /label=ORF\6
FT                      /note="orf6"
FT        CDS           4021..4836
FT                      /vntifkey="4"
FT                      /label=Km**
FT                      /note="Km**"
FT        promoter      3556..4015
FT                      /vntifkey="30"
FT                      /label=PrbcL
FT        CDS           2450..3454
FT                      /vntifkey="4"
FT                      /label=Adh1520
FT        promoter      2052..2448
FT                      /vntifkey="30"
FT                      /label=PcpcB
FT        CDS           291..1993
FT                      /vntifkey="4"
FT                      /label=zmPDC(opt)
SQ        Sequence 12983 BP; 4104 A; 2341 C; 2529 G; 4009 t
```

FIG. 137 (continued)

```
FT                    /label=ORF\2
FT                    /note="orf2"
FT      CDS           complement(10420..11184)
FT                    /vntifkey="4"
FT                    /label=ORF\3
FT                    /note="orf3"
FT      CDS           11510..12196
FT                    /vntifkey="4"
FT                    /label=ORF\4
FT                    /note="orf4 Integrase/Recombinase Similar to Site-specific
recombinase of Bacillus thuringiensis serovar israelensis ATCC 35646"
FT      CDS           12238..12501
FT                    /vntifkey="4"
FT                    /label=ORF\5
FT                    /note="orf5"
FT      CDS           12498..12746
FT                    /vntifkey="4"
FT                    /label=ORF\6
FT                    /note="orf6"
FT      CDS           4121..4936
FT                    /vntifkey="4"
FT                    /label=Km**
FT                    /note="Km**"
FT      promoter      3056..4119
FT                    /vntifkey="30"
FT                    /label=PrbcL
FT      promoter      2056..3452
FT                    /vntifkey="30"
FT                    /label=PcpcB
FT      terminator    3477..3635
FT                    /vntifkey="43"
FT                    /label=TrbcS
FT      CDS           2454..3470
FT                    /vntifkey="4"
FT                    /label=AdhB11(opt)
FT                    /note="codon optimized for A6CC171"
FT      promoter      4..284
FT                    /vntifkey="30"
FT                    /label=PnirA*2
FT                    /note="optimized nirA promoter"
FT      CDS           285..1991
FT                    /vntifkey="4"
FT                    /label=zmPDC171(opt3)
SQ      Sequence 13083 BP; 4199 A; 2295 C; 2554 G; 4035 T;
```

FIG. 150 (continued)

```
FT                  /vntifkey="32"
FT                  /label=Rep_Origin_1
FT                  /note="potential rep origin; match pNostoc (Acc# M81381) nick
site (358-375); on reverse strand"
FT      CDS         9963..10140
FT                  /vntifkey="4"
FT                  /label=ORF\2
FT                  /note="orf2"
FT      CDS         complement(10408..11172)
FT                  /vntifkey="4"
FT                  /label=ORF\3
FT                  /note="orf3"
FT      CDS         11498..12184
FT                  /vntifkey="4"
FT                  /label=ORF\4
FT                  /note="orf4 Integrase/Recombinase Similar to Site-specific
recombinase of Bacillus thuringiensis serovar israelensis ATCC 35646"
FT      CDS         12226..12489
FT                  /vntifkey="4"
FT                  /label=ORF\5
FT                  /note="orf5"
FT      CDS         12486..12734
FT                  /vntifkey="4"
FT                  /label=ORF\6
FT                  /note="orf6"
FT      CDS         4109..4924
FT                  /vntifkey="4"
FT                  /label=Km**
FT                  /note="Km**"
FT      promoter    3644..4107
FT                  /vntifkey="30"
FT                  /label=PrbcL
FT      promoter    2056..2455
FT                  /vntifkey="30"
FT                  /label=PcpcB
FT      terminator  3463..3617
FT                  /vntifkey="43"
FT                  /label=TrbcS
FT      CDS         2454..3461
FT                  /vntifkey="4"
FT                  /label=AdhB1E(opt)
FT                  /note="Adh from ABCC816 codon optimized for ABCC171 (by Kui)"
FT      promoter    4..284
FT                  /vntifkey="30"
FT                  /label=PnirA*2
FT                  /note="improved nirA promoter"
FT      CDS         285..1991
FT                  /vntifkey="4"
FT                  /label=zmPDC(opt3)
SQ      Sequence 13071 BP; 4190 A; 3311 C; 2534 G; 4036 t;
```

FIG. 151 (continued)

```
FT                    /note="orf4 Integrase/Recombinase Similar to Site-specific
recombinase of Bacillus thuringiensis serovar israelensis ATCC 35646"
FT    CDS             complement(10401..11160)
FT                    /vntifkey="4"
FT                    /label=ORF\3
FT                    /note="orf3"
FT    CDS             9956..10141
FT                    /vntifkey="4"
FT                    /label=ORF\2
FT                    /note="orf2"
FT    rep_origin      complement(9256..9273)
FT                    /vntifkey="33"
FT                    /label=Rep_Origin_1
FT                    /note="potential rep origin; match pNostoc (Acc# SS1381) nick
site (356-375); on reverse strand"
FT    misc_feature    9516..9549
FT                    /vntifkey="21"
FT                    /label=Rep\motif
FT                    /note="Rep protein active site motif EXXKTSVKXXD"
FT    CDS             6735..9929
FT                    /vntifkey="4"
FT                    /label=ORF\1
FT                    /note="orf1  rep ori binding protein slr7037 homolog Similar to
hypothetical protein slr7037 of plasmid pSYSA (103 kb)  of Synechocystis sp. PCC 6803"
FT    primer_bind     complement(5523..5554)
FT                    /vntifkey="28"
FT                    /label=Rom-F
FT    primer_bind     5205..5236
FT                    /vntifkey="28"
FT                    /label=Rom-R
FT    rep_origin      complement(5160..6210)
FT                    /vntifkey="33"
FT                    /label=OriVT
FT    terminator      1996..2051
FT                    /vntifkey="43"
FT                    /label=desA
FT    terminator      3458..3616
FT                    /vntifkey="43"
FT                    /label=TrbcS
FT    CDS             2450..3451
FT                    /vntifkey="4"
FT                    /label=Adh1520(opt)
FT    promoter        2052..2448
FT                    /vntifkey="30"
FT                    /label=PcpcB
FT    CDS             285..1991
FT                    /vntifkey="4"
FT                    /label=amPCC(opt1)
SQ    Sequence 13064 BP; 4136 A; 2301 C; 2537 G; 4090 t;
```

FIG. 152 (continued)

```
FT                      /vntifkey="21"
FT                      /label=Rep\motif
FT                      /note="Rep protein active site motif SXXKYXVKKXE"
FT     rep_origin       complement(9328..9343)
FT                      /vntifkey="33"
FT                      /label=Rep_Origin_1
FT                      /note="potential rep origin; match pNostoc (Acc# M81381) nick
site (359-375); on reverse strand"
FT     CDS              10026..10211
FT                      /vntifkey="4"
FT                      /label=ORF\2
FT                      /note="orf2"
FT     CDS              complement(10471..11235)
FT                      /vntifkey="4"
FT                      /label=ORF\3
FT                      /note="orf3"
FT     CDS              11561..12247
FT                      /vntifkey="4"
FT                      /label=ORF\4
FT                      /note="orf4 Integrase/Recombinase Similar to Site-specific
recombinase of Bacillus thuringiensis serovar israelensis ATCC 35646"
FT     CDS              12289..12552
FT                      /vntifkey="4"
FT                      /label=ORF\5
FT                      /note="orf5"
FT     CDS              12549..12797
FT                      /vntifkey="4"
FT                      /label=ORF\6
FT                      /note="orf6"
FT     CDS              4172..4987
FT                      /vntifkey="4"
FT                      /label=Kan
FT                      /note="Kan"
FT     promoter         3707..4170
FT                      /vntifkey="30"
FT                      /label=PrbcL
FT     promoter         2187..2503
FT                      /vntifkey="30"
FT                      /label=PcpcB
FT     terminator       3529..3686
FT                      /vntifkey="43"
FT                      /label=TrbcL
FT     CDS              2505..3521
FT                      /vntifkey="4"
FT                      /label=Adh111(opt)
FT                      /note="codon optimized for ASCC171"
FT     CDS              336..2045
FT                      /vntifkey="4"
FT                      /label=PDC(opt3)
SQ     Sequence 13134 BP; 4239 A; 2289 C; 2565 G; 4041 t;
```

FIG. 153 (continued)

```
FT                    /label=Rep\motif
FT                    /note="Rep protein active site motif EXXKYXVKKXD"
FT   rep_origin       complement(9314..9331)
FT                    /vntifkey="33"
FT                    /label=Rep_Origin_1
FT                    /note="potential rep origin; match pNoster (Acc# X61381) nick
site (358-375); on reverse strand"
FT   CDS              10014..10199
FT                    /vntifkey="4"
FT                    /label=ORF\2
FT                    /note="orf2"
FT   CDS              complement(10459..11223)
FT                    /vntifkey="4"
FT                    /label=ORF\3
FT                    /note="orf3"
FT   CDS              11549..12235
FT                    /vntifkey="4"
FT                    /label=ORF\4
FT                    /note="orf4 Integrase/Recombinase Similar to Site-specific
recombinase of Bacillus thuringiensis serovar israelensis ATCC 35646"
FT   CDS              12277..12540
FT                    /vntifkey="4"
FT                    /label=ORF\5
FT                    /note="orf5"
FT   CDS              12537..12785
FT                    /vntifkey="4"
FT                    /label=ORF\6
FT                    /note="orf6"
FT   CDS              4160..4975
FT                    /vntifkey="4"
FT                    /label=Km^r
FT                    /note="Km^r"
FT   promoter         3695..4159
FT                    /vntifkey="30"
FT                    /label=PrbcL
FT   promoter         2107..2503
FT                    /vntifkey="30"
FT                    /label=PcpcB
FT   terminator       3514..3669
FT                    /vntifkey="43"
FT                    /label=TrbcS
FT   CDS              2505..3512
FT                    /vntifkey="4"
FT                    /label=Adh918(opt)
FT                    /note="Adh from ABCC918 codon optimized for ABCC171 (by Kui)"
FT   CDS              336..2042
FT                    /vntifkey="4"
FT                    /label=zmPDC(opt3)
SQ   Sequence 13122 BP; 4230 A; 2305 C; 2545 G; 4042 T;
```

```
FT                    /note="orf4 Integrase/Recombinase Similar to Site-specific
recombinase of Bacillus thuringiensis serovar israelensis ATCC 35646"
FT        CDS         complement(10452..11216)
FT                    /vntifkey="4"
FT                    /label=ORF\3
FT                    /note="orf3"
FT        CDS         10007..10192
FT                    /vntifkey="4"
FT                    /label=ORF\2
FT                    /note="orf2"
FT        rep_origin  complement(9307..9324)
FT                    /vntifkey="33"
FT                    /label=Rep_Origin_1
FT                    /note="potential rep origin; match pWcator (Acc# 881351) nick
site (356-375); on reverse strand"
FT        misc_feature 9567..9600
FT                    /vntifkey="21"
FT                    /label=Rep\motif
FT                    /note="Rep protein active site motif EXXKYXVKXND"
FT        CDS         6784..9971
FT                    /vntifkey="4"
FT                    /label=ORF\1
FT                    /note="orf1   rep ori binding protein slr7037 homolog Similar to
hypothetical protein slr7037 of plasmid pSYSA (103 kb)  of Synechocystis sp. PCC 6803"
FT        primer_bind complement(5574..5605)
FT                    /vntifkey="28"
FT                    /label=Scm-F
FT        primer_bind 5256..5287
FT                    /vntifkey="28"
FT                    /label=Scm-R
FT        rep_origin  complement(5211..6269)
FT                    /vntifkey="33"
FT                    /label=OriVT
FT        terminator  2947..3102
FT                    /vntifkey="43"
FT                    /label=darA
FT        terminator  3599..3667
FT                    /vntifkey="43"
FT                    /label=TrbcS
FT        CDS         2681..3582
FT                    /vntifkey="4"
FT                    /label=AdhI829(opt)
FT        promoter    2103..2499
FT                    /vntifkey="30"
FT                    /label=PrpcB
FT        CDS         336..2042
FT                    /vntifkey="4"
FT                    /label=zmPYK(opt)
SQ       Sequence 13115 BP; 4176 A; 2295 C; 2548 G; 4096 t
```

FIG. 155 (continued)

```
FT   CDS             13980..14143
FT                   /vntifkey="4"
FT                   /label=ORF\5
FT                   /note="orf5"
FT   CDS             13152..13938
FT                   /vntifkey="4"
FT                   /label=ORF\4
FT                   /note="orf4 Integrase/Recombinase Similar to Site-specific
recombinase of Bacillus thuringiensis serovar israelensis ATCC 35646"
FT   CDS             complement(12062..12826)
FT                   /vntifkey="4"
FT                   /label=ORF\3
FT                   /note="orf3"
FT   CDS             11617..11802
FT                   /vntifkey="4"
FT                   /label=ORF\2
FT                   /note="orf2"
FT   rep_origin      complement(10917..10934)
FT                   /vntifkey="33"
FT                   /label=Rep_Origin_1
FT                   /note="potential rep origin; match pNostoc (Acc# N81381) nick
site (358-375); on reserve strand"
FT   misc_feature    11177..11210
FT                   /vntifkey="21"
FT                   /label=Rep\motif
FT                   /note="Rep protein active site motif EXXKXXVKXXD"
FT   CDS             8396..11581
FT                   /vntifkey="4"
FT                   /label=ORF\1
FT                   /note="orf1  rep ori binding protein slr7037 homolog Similar to
hypothetical protein slr7037 of plasmid pSYSA (103 kb)  of Synechocystis sp. PCC 6803"
FT   primer_bind     complement(7184..7215)
FT                   /vntifkey="28"
FT                   /label=Bom-F
FT   primer_bind     6866..6897
FT                   /vntifkey="28"
FT                   /label=Bom-R
FT   rep_origin      complement(6821..7879)
FT                   /vntifkey="33"
FT                   /label=OriVT
FT   promoter        1..283
FT                   /vntifkey="30"
FT                   /label=PnirA
FT   terminator      1999..2054
FT                   /vntifkey="43"
FT                   /label=dsrA
FT   terminator      6250..6295
FT                   /vntifkey="43"
FT                   /label=dsrA
FT   promoter        3197..3516
FT                   /vntifkey="30"
FT                   /label=Porf0221
FT   CDS             3517..5223
FT                   /vntifkey="4"
FT                   /label=zmPDC(opt1)
FT   promoter        2056..2119
FT                   /label=Prbc* (optRBS)
SQ   Sequence 14725 BP; 4509 A; 2665 C; 2995 G; 4547 T
```

FIG. 156 (continued)

```
FT                    /vntifkey="4"
FT                    /label=zmPDC(opt1)
FT     terminator     1995..2051
FT                    /vntifkey="43"
FT                    /label=dsrA
FT     promoter       1..283
FT                    /vntifkey="30"
FT                    /label=PnirA
FT     CDS            2116..3126
FT                    /vntifkey="4"
FT                    /label=synADH
FT     promoter       2054..2115
FT                    /vntifkey="30"
FT                    /label=Prbc*(optRBS)
SQ     Sequence 9185 BP; 2762 A; 1690 C; 1951 G; 2782 t;
```

FIG. 157 (continued)

```
FT                  /label=Porf0316
FT      CDS         2156..3178
FT                  /vntifkey="4"
FT                  /label=synADH
FT      terminator  2947..2102
FT                  /vntifkey="43"
FT                  /label=dsrA
FT      CDS         342..2045
FT                  /vntifkey="4"
FT                  /label=zmPDC(opt1)
FT      promoter    2104..2167
FT                  /vntifkey="30"
FT                  /label=Pabc'(optRBS)
FT      terminator  2385..2441
FT                  /vntifkey="43"
FT                  /label=dsrA
SQ      Sequence 9237 BP; 2800 A; 1684 C; 1964 G; 2789 t
```

FIG. 158 (continued)

```
FT                /label=dsrA
FT    promoter    1..203
FT                /vntifkey="30"
FT                /label=PhlnA
FT    CDS         2116..3126
FT                /vntifkey="4"
FT                /label=synADH
FT    CDS         264..1990
FT                /vntifkey="4"
FT                /label=PDC(opt)
FT    promoter    2054..2115
FT                /vntifkey="30"
FT                /label=Prbc*(optRBO)
SQ    Sequence 9050 BP; 2735 A; 1664 C; 1913 G; 2738 t;
```

FIG. 159 (continued)

```
FT                      /vntifkey="4"
FT                      /label=zmPDC(opt1)
FT     promoter         6..335
FT                      /vntifkey="30"
FT                      /label=Porf0315
FT     promoter         2099..2167
FT                      /vntifkey="30"
FT                      /label=Prbc' (optRBS)
FT     CDS              2168..3178
FT                      /vntifkey="4"
FT                      /label=synADH
FT     terminator       2047..2103
FT                      /vntifkey="43"
FT                      /label=dsrA
SQ     Sequence 9102 BP; 2773 A; 1658 C; 1926 G; 2745 t;
```

FIG. 160 (continued)

```
FT                      /vntifkey="4"
FT                      /label=Km**
FT                      /note="Km**"
FT      CDS             14067..14315
FT                      /vntifkey="4"
FT                      /label=ORF\6
FT                      /note="orf6"
FT      CDS             13807..14070
FT                      /vntifkey="4"
FT                      /label=ORF\5
FT                      /note="orf5"
FT      CDS             13079..13765
FT                      /vntifkey="4"
FT                      /label=ORF\4
FT                      /note="orf4 Integrase/Recombinase Similar to Site-specific
recombinase of Bacillus thuringiensis serovar israelensis ATCC 35646"
FT      CDS             complement(11989..12753)
FT                      /vntifkey="4"
FT                      /label=ORF\3
FT                      /note="orf3"
FT      CDS             11544..11729
FT                      /vntifkey="4"
FT                      /label=ORF\2
FT                      /note="orf2"
FT      rep_origin      complement(10844..10861)
FT                      /vntifkey="33"
FT                      /label=Rep_Origin_1
FT                      /note="potential rep origin; match pRostcc (Acc# M81381) nick
site (356-375); on reverse strand"
FT      misc_feature    11104..11137
FT                      /vntifkey="21"
FT                      /label=Rep\motif
FT                      /note="Rep protein active site motif EXXKYXVKXXD"
FT      CDS             8323..11508
FT                      /vntifkey="4"
FT                      /label=ORF\1
FT                      /note="orf1  rep ori binding protein slr7037 homolog Similar to
hypothetical protein slr7037 of plasmid pSYSA (103 kb)  of Synechocystis sp. PCC 6803"
FT      primer_bind     complement(7111..7142)
FT                      /vntifkey="28"
FT                      /label=Bom-F
FT      primer_bind     6793..6824
FT                      /vntifkey="28"
FT                      /label=Bom-R
FT      rep_origin      complement(6748..7806)
FT                      /vntifkey="33"
FT                      /label=ColVT
FT      promoter        1..283
FT                      /vntifkey="30"
FT                      /label=PrbcA
FT      terminator      1998..2053
FT                      /label=dsrA
FT      terminator      5177..5222
FT                      /label=dsrA
FT      promoter        3196..3443
FT                      /label=Porf3126
FT      CDS             3444..5150
FT                      /label=zmPDC(opt1)
SQ      Sequence 14652 BP; 4877 A; 2671 C; 2955 G; 4549 t;
```

FIG. 161 (continued)

CYANOBACTERIUM SP. FOR PRODUCTION OF COMPOUNDS

CROSS-REFERENCE TO RELATED APPLICATION

This application claims priority to U.S. provisional application No. 61/741,000 filed on Dec. 21, 2012, and U.S. provisional application No. 61/835,294 filed on Jun. 14, 2013, which are each herein incorporated by reference in their entirety and for all purposes.

STATEMENT REGARDING FEDERALLY SPONSORED RESEARCH

This invention was made in part with United States government support under the Department of Energy grant number DE-EE0002867. The government has certain rights associated with this invention.

REFERENCE TO SEQUENCE LISTING

This application contains a sequence listing submitted by EFS-Web, thereby satisfying the requirements of 37 C.F.R. §1.821-1.825.

FIELD OF INVENTION

The present disclosure relates to the genetic enhancement of cyanobacteria to produce compounds of interest.

BACKGROUND

Cyanobacteria are prokaryotes capable of photoautotrophy. Cyanobacteria can be genetically enhanced to use light and $CO_2$ to produce compounds of interest such as biofuels, industrial chemicals, pharmaceuticals, nutrients, carotenoids, and food supplements. Various cyanobacterial strains have been genetically enhanced to produce compounds of interest. Carbon dioxide that is used by cyanobacteria can be derived from any source, such as a waste byproduct of industrial production. In this way, cyanobacteria can be used to recycle $CO_2$ to compounds of interest.

The transformation of the cyanobacterial genus *Synechococcus* with genes that encode enzymes that can produce ethanol for biofuel production has been described (U.S. Patent Nos. 6,699,696 and 6,306,639, both to Woods et al.). The transformation of the cyanobacterial genus *Synechocystis* has been described, for example, in PCT/EP2009/000892 and in PCT/EP2009/060526.

The cyanobacterial genus *Cyanobacterium* was first established in 1983 (see Rippka et al. (2001), Bergey's Manual of Systematic Bacteriology, Vol. 1, p. 497-498). In general, the genus differs from the genus *Synechococcus* by differences in DNA base composition and by differences in sensitivity to cyanophages (Moro, et al., 2007, Algological Studies, 123:1-15). Members of the *Cyanobacterium* genus are often found in thermal mats.

SUMMARY

This disclosure provides non-naturally occurring *Cyanobacterium* sp. ABICyano1 organisms containing ethanologenic pathways with at least one exogenous nucleic acid encoding an ethanologenic pathway enzyme expressed in a sufficient amount to produce ethanol. This disclosure additionally provides methods of using such *Cyanobacterium* sp. ABICyano1 organisms to produce ethanol by culturing the non-naturally occurring, genetically enhanced *Cyanobacterium* sp. ABICyano1 organisms containing ethanologenic pathways as described herein under conditions and for a sufficient period of time to produce ethanol.

In an aspect, a non-naturally occurring ethanologenic *Cyanobacterium* sp. organism derived from *Cyanobacterium* sp. ABICyano1 is disclosed, wherein said organism comprises a genetically enhanced plasmid derived from a plasmid that is endogenous to *Cyanobacterium* sp. ABICyano1, and wherein said organism produces ethanol from about 0.002% (vol/vol) per day up to about 0.07% (vol/vol) per day. In an embodiment, the non-naturally occurring ethanologenic *Cyanobacterium* sp. organism is capable of producing ethanol at a rate of 0.07% (vol/vol) per day. In another embodiment, the non-naturally occurring ethanologenic *Cyanobacterium* sp. organism is capable of producing ethanol at a rate of 0.047% (vol/vol) per twelve hours. In another embodiment, the non-naturally occurring ethanologenic *Cyanobacterium* sp. organism is capable of producing ethanol at a rate of about 0.0201% (vol/vol) per day at about 114 days of growth. In another embodiment, the non-naturally occurring ethanologenic *Cyanobacterium* sp. organism produces ethanol at about 135 days of growth. In another embodiment, the non-naturally occurring ethanologenic *Cyanobacterium* sp. organism comprises *Cyanobacterium* sp. ABICyano1 deposited in the American Type Culture Collection (ATCC) under ATCC accession number PTA-13311, and further comprises an ethanologenic pathway comprising at least one exogenous nucleic acid encoding an ethanologenic pathway enzyme expressed in a sufficient amount for the organism to produce ethanol, said ethanologenic pathway comprising a pyruvate decarboxylase, and an alcohol dehydrogenase. In yet another embodiment, the non-naturally occurring ethanologenic *Cyanobacterium* sp. organism of has a genetically enhanced plasmid that is derived from a 6.8 kb plasmid endogenous to *Cyanobacterium* sp. ABICyano1 consisting of SEQ ID NO: 1. In another embodiment, the non-naturally occurring ethanologenic *Cyanobacterium* sp. organism contains a genetically enhanced plasmid having at least 50% of a 6.8 kb plasmid endogenous to *Cyanobacterium* sp. ABICyano1 consisting of SEQ ID NO: 1. In another embodiment, the non-naturally occurring ethanologenic *Cyanobacterium* sp. organism comprises one, two, or three exogenous nucleic acids each encoding an ethanologenic pathway enzyme. In an embodiment, the non-naturally occurring ethanologenic *Cyanobacterium* sp. organism comprises a heterologous adh gene and a heterologous pdc gene, and the adh gene is operably linked to a promoter, and the pdc gene is operably linked to a promoter. In an embodiment, the non-naturally occurring ethanologenic *Cyanobacterium* sp. organism has a heterologous adh gene that encodes for an alcohol dehydrogenase that has an amino acid sequence identity of at least 60% to the amino acid sequence identity of the enzyme encoded for by nucleotides 117 to 1127 of SEQ ID NO: 48. In another embodiment, the non-naturally occurring ethanologenic *Cyanobacterium* sp. organism has a heterologous pdc gene that encodes for a pyruvate decarboxylase that has an amino acid sequence identity of at least 60% to the amino acid sequence identity of the enzyme encoded for by nucleotides 379 to 2085 of SEQ ID NO: 43. In yet another embodiment, the non-naturally occurring ethanologenic *Cyanobacterium* sp. organism contains a plasmid selected from plasmids comprising polynucleotide sequences that are 90% or more identical to the polynucleotide sequence of any of SEQ ID NOs 43, 61, 62, 66, 72, 73, 74, 82, 83, 84, 85, and 106. In an embodiment, the non-naturally occurring ethanologenic

*Cyanobacterium* sp. organism has a promoter operably linked to the adh gene that is constitutive, and the promoter that is operably linked to the pdc gene is inducible. In another embodiment, the non-naturally occurring ethanologenic *Cyanobacterium* sp. organism has a promoter operably linked to the adh gene that is selected from the group consisting of Prbc, Prbc*, PcpcB, PrpsL*4 and PrpsL. In another embodiment, the non-naturally occurring ethanologenic *Cyanobacterium* sp. organism has a promoter operably linked to the pdc gene that is selected from promoters inducible by the presence or absence of nitrate and/or copper. In another embodiment, the non-naturally occurring ethanologenic *Cyanobacterium* sp. organism has a promoter or promoters operably linked to a pdc gene that is selected from the group consisting of endogenous PnirA, PnirA, PnirA*1, PnirA*2, PnirA*3, PnirA*4, Porf0221, Porf0223, and Porf0316. In an embodiment, the non-naturally occurring ethanologenic *Cyanobacterium* sp. organism has a promoter that is operably linked to said adh gene is endogenous to *Cyanobacterium* sp., and wherein said promoter operably linked to the pdc gene and is endogenous to *Cyanobacterium* sp. In another embodiment, the non-naturally occurring ethanologenic *Cyanobacterium* sp. organism of contains a promoter that is operably linked to the adh gene and a promoter operably linked to the pdc gene and the promoters are selected from promoters comprising polynucleotide sequences that are 90% or more identical to the polynucleotide sequence of any of SEQ ID NOs 9-41. In another embodiment, the non-naturally occurring ethanologenic *Cyanobacterium* sp. organism contains genetically enhanced plasmids that are selected from plasmids comprising polynucleotide sequences that are 90% or more identical to the polynucleotide sequence of any of SEQ ID NOs: 62, 66, 82, 83, 84, 85, and 106.

In another aspect, a non-naturally occurring ethanologenic *Cyanobacterium* sp. organism comprising *Cyanobacterium* sp. ABICyano1 deposited in the American Type Culture Collection (ATCC) under ATCC accession number PTA-13311, and the organisms further comprises an ethanologenic pathway comprising one, two, or three exogenous nucleic acids each encoding an ethanologenic pathway enzyme expressed in a sufficient amount to produce ethanol, and wherein the ethanologenic pathway has been introduced into the chromosomal DNA of the *Cyanobacterium* sp. ABICyano1, and wherein the ethanologenic pathway comprises at least one pyruvate decarboxylase gene operably linked to a promoter and an alcohol dehydrogenase gene operably linked to a promoter. In an embodiment, the non-naturally occurring ethanologenic *Cyanobacterium* sp. organism further comprises a chromosomal knockout of one or more recJ homologs from *Cyanobacterium* sp. ABICyano1 selected from the group consisting of SEQ ID NOs: 127 and 128. In another embodiment, the non-naturally occurring ethanologenic *Cyanobacterium* sp. organism contains an ethanologenic pathway that has been introduced into the chromosomal DNA of the *Cyanobacterium* sp. ABICyano1 by transforming the non-naturally occurring ethanologenic *Cyanobacterium* sp. organism with one or more integrative plasmid. In another embodiment, the non-naturally occurring ethanologenic *Cyanobacterium* sp. organism has an integrative plasmid that is selected from plasmids comprising polynucleotide sequences that are 90% or more identical to the polynucleotide sequence of any of SEQ ID NOs: 107, 108, 109 and 110.

In another aspect, a method for producing ethanol is disclosed comprising growing a non-naturally occurring ethanologenic *Cyanobacterium* sp. organism comprising *Cyanobacterium* sp. ABICyano1 deposited in the American Type Culture Collection (ATCC) under ATCC accession number PTA-13311, and further comprising an ethanologenic pathway comprising at least one exogenous nucleic acid encoding an ethanologenic pathway enzyme expressed in a sufficient amount for the organism to produce ethanol, and the ethanologenic pathway comprises a pyruvate decarboxylase, and an alcohol dehydrogenase. In an embodiment, the method produces ethanol from about 0.002% vol/vol ethanol per day up to about 0.07% vol/vol ethanol per day. In another embodiment, the organism is capable of producing ethanol at a rate of 0.07% (vol/vol) per day. In yet another embodiment, the organism is capable of producing ethanol at a rate of 0.047% (vol/vol) per twelve hours. In another embodiment, ethanol is produced at a rate of about 0.0201% (vol/vol) per day at about 114 days of growth. In an embodiment, a method for producing ethanol is disclosed wherein the non-naturally occurring ethanologenic *Cyanobacterium* sp. organism comprises a plasmid selected from plasmids comprising polynucleotide sequences that are 90% or more identical to the polynucleotide sequence of any of SEQ ID NOs 43, 61, 62, 66, 72, 73, 74, 82, 83, 84, 85, and 106.

In an aspect, a genetically enhanced *Cyanobacterium* sp. host cell comprising at least one recombinant gene, wherein the recombinant gene encodes one protein selected from a group consisting of a protein that is involved in a biosynthetic pathway for the production of a chemical compound or a marker protein. In an embodiment, the host cell is *Cyanobacterium* sp. ABICyano1 or a *Cyanobacterium* sp. host cell derived from the host cell *Cyanobacterium* sp. ABICyano1 by the introduction of further genetic enhancements. In an embodiment, the host cell can withstand at least one of the following culturing conditions: at least 1%, 2%, 3% or 4% (v/v) ethanol in the medium for at least 6, 12 or 16 weeks, at least 48° C., preferably at least 50° C. or at least 53 to 55° C. for at least 2 hour peaks over at least 7 days, and purging with 60% (v/v) to 80% oxygen. In another embodiment, the host cell has recombinant genes that are located on an extrachromosomal plasmid. In another embodiment, the host cell of the previous claim, wherein the extrachromosomal plasmid contains cyanobacterial nucleic acid sequences. In another embodiment, the extrachromosomal plasmid is derived from a plasmid that is endogenous to the *Cyanobacterium* sp. host cell. In another embodiment, the recombinant gene is integrated into an endogenous extrachromosomal 6.8 kb plasmid from *Cyanobacterium* sp. ABICyano1 comprising a polynucleotide sequence of SEQ ID NO: 1. In another embodiment, the extrachromosomal plasmid comprises the recombinant gene, and an origin of replication suitable for replication in the *Cyanobacterium* sp. ABICyano1. In another embodiment, the host cell further comprises one gene coding for a replication initiation factor binding to the origin of replication. In an embodiment, the host cell of the previous claim, wherein the gene coding for a replication initiation factor is included on the extrachromosomal plasmid. In another embodiment, the sequence of the origin of replication has at least 90%, preferably 95% identity or is identical to the nucleotides 3375 to 3408 of the sequence of the endogenous 6.8 kb plasmid having a polynucleotide sequence comprising SEQ ID NO: 1. In another embodiment, the host cell has a gene for the replication initiation factor that codes for a protein having at least 90%, preferably 95% sequence identity or is identical to the protein coded by nucleotides 594 to 3779 of the sequence of the endogenous 6.8 kb plasmid having a polynucleotide sequence comprising SEQ ID NO: 1. In another embodiment, the extrachromosomal plasmid comprises a sequence with a sequence identity of at least 90%, preferably 95% to the sequence of the endogenous 6.8 kb plasmid having a polynucleotide sequence comprising SEQ ID NO: 1. In yet another embodiment, the extrachromosomal plasmid comprises a recombinant origin of transfer for conjugation. In an embodiment, the extrachromosomal plasmid is a shuttle vector that is able to replicate in two different host species. In an embodiment, the shuttle vector comprises a cyanobacterial origin of replication and an origin of replication for *Enterobacteriaceae*, in particular *E. coli*. In another embodiment, the the at least one recombinant gene is codon improved for enhancing translation by adapting the codon usage of the at least one recombinant gene to the codon usage of *Cyanobacterium* sp., in particular *Cyanobacterium* ABI-Cyano1. In an embodiment, the G and/or C wobble bases in the codons have been replaced by A and/or T. In an embodiment, the recombinant gene is integrated into a chromosome of the host cell. In another embodiment, the recombinant gene is integrated into an endogenous gene of the host cell thereby leading to a gene inactivation of the endogenous gene. In an embodiment, the protein is involved in a biosynthetic pathway for the production of a chemical compound. In another embodiment, the chemical compound is a biofuel or another organic compound. In yet another embodiment, the biofuel or the other organic compound is selected from a group consisting of alcohols, alkanes, polyhydroxyalkanoates, fatty acids, fatty acid esters, carboxylic acids, amino acids, hydrogen, terpenes, terpenoids, peptides, polyketides, alkaloids, lactams, pyrrolidone, alkenes, ethers, tetrahydrofuran and combinations thereof. In another embodiment, the chemical compound is an alcohol. In another embodiment, the chemical compound is ethanol. In another embodiment, the genes for ethanol production are selected from a group of genes consisting of pdc coding for PDC enzyme catalyzing the interconversion between pyruvate and acetaldehyde, adh coding for ADH enzyme catalyzing the interconversion between acetaldehyde and ethanol, and adhE, coding for AdhE enzyme catalyzing the interconversion between acetyl-CoA and ethanol. In yet another embodiment, the at least one recombinant gene is under the control of either a constitutive or inducible promoter. In an embodiment, the promoter is a cyanobacterial promoter. In an embodiment, the promoter is endogenous to the genetically enhanced *Cyanobacterium* sp. In another embodiment, the promoter has at least 90% sequence identity to an endogenous promoter of the genetically enhanced *Cyanobacterium* sp. In an embodiment, the promoter is an inducible promoter selected from a group consisting of PnirA, PziaA, PsmtA, PcorT, PnrsB, PnrtA, PpetJ, PnarB and other metal-ion inducible promoters and variations thereof. In another embodiment, the promoter is an inducible promoter and has at least 90%, preferably 95% sequence identity or is identical to the promoters having SEQ ID NOs 9-41. In an embodiment, the promoter is an inducible promoter having the following general nucleotide sequences of SEQ ID NOs: 112 to 124. In another embodiment, the promoter is a constitutive promoter selected from a group consisting of: PrpsL, PcpcB, Prbc, PpetE and variations thereof. In an embodiment, the promoter includes nucleotide changes in either one of the ribosomal binding site, the TATA box, the operator or the 5'-UTR (untranslated region). In another embodiment, the promoter is selected from PnirA, PcorT and PsmtA . In another embodiment, the host cell comprises at least a first and a second recombinant gene. In an embodiment, the first and second recombinant genes are under the transcriptional control of different first and second promoters and the first recombinant gene encodes pyruvate decarboxylase and the second recombinant gene encodes alcohol dehydrogenase. In another embodiment, a transcription terminator is present between the first and second recombinant gene. In an embodiment, the first recombinant gene encodes pyruvate decarboxylase and the second recombinant gene encodes alcohol dehydrogenase and wherein the first recombinant gene is under the transcriptional control of a first inducible promoter and wherein the second recombinant gene is under the transcriptional control of a second constitutive promoter. In an embodiment, the second constitutive promoter is selected from a group consisting of the following from PrpsL*4: GAGCTCTAGAAAAACTATTGACAAAC-CCATAAAAAATGTGATATAATTATAGATTGT CACTG-GTATTTTATACTAGAGGCAAATTATATT-TATATATACAAAAATGCTGTAGGA GGATCAGCCATATG (SEQ ID NO: 124), Prbc*(optRBS) with the sequence: ACTAG TTGACATAAG TAAAG-GCATC CCCTGCGTGA TATAATTACCTTCAGTTTAA GGAGGTATACACAT (SEQ ID NO: 129), and PcpcB with sequence: TGAGAAAAAGTGTAAACAAATATTAA-GAAAAAGATCAGAAAAATTTAACAACACGT AATAAAAAAATGCGTCACTACGGGT-TATAAATTTACATGAAAGGTTAAAACACTTTT CTGAGACGATTTTGATAAAAAAGTTGT-CAAAAAATTAAGTTTCTTTACAAATGCTTA ACAAAAACTTGGTTTTAAGCA-CAAAATAAGAGAGACTAATTTGCAGAAGTTTTACAA GGAAATCTTGAAGAAAAAGATCTAAG-TAAAACGACTCTGTTTAACCAAAATTTAACA AATT-TAACAAAACAAACTAAATCTATTAG-GAGATTAACTAAGC (SEQ ID NO: 9). In another embodiment, the host cell is able to produce ethanol in quantities of at least 0.025% (v/v) per day, preferably at least 0.03% (v/v) per day, most preferred at least 0.0493% (v/v) per day. In another embodiment, the host cell of any of the previous claims for ethanol production, wherein the first recombinant gene encodes AdhE enzyme directly converting acetyl-CoA to ethanol.

In an aspect, a transformable *Cyanobacterium* sp. cell is disclosed that comprises an extracellular polymer layer (EPS) pretreated with compounds selected from a group consisting of: N-acetylcysteine, lysozyme, β-galactosidase and combinations thereof In another aspect, a method for producing a chemical compound is disclosed comprising the method steps of: a) culturing the genetically enhanced cyanobacterial host cells according to any of the preceding claims in a culture medium, the host cells thereby producing the chemical compound, and b) retrieving the chemical compound from either one of the host cells, the medium or the headspace above the medium, and wherein during method step A) the host cells are subjected to light and CO2.

In another aspect, disclosed is a method for producing a genetically enhanced *Cyanobacterium* sp. host cell comprising introducing the recombinant gene into the genome of the host cell comprising the method steps of:

A) subjecting the host cell to compounds increasing the permeability of the extracellular polymeric layer (EPS) and cell wall, respectively of the host cell, and B) introducing the recombinant nucleic acid sequence into the host cell. In an embodiment, the recombinant nucleic acid sequence comprises an extrachromosomal plasmid. In another embodiment, the extrachromosomal plasmid is derived from an endogenous plasmid of the host cell by at least the introduction of the recombinant gene. In another embodiment, the method comprises protecting the recombinant nucleic acid sequence against endogenous restriction endonucleases of the host cell by for example methylating at least a part of the recombinant nucleic acid sequence or modifying and/or eliminating the recognition sequences of the endogenous restriction endonucleases and wherein the recombinant nucleic acid sequence is subjected to methyltransferases, for example M.AvaI and M.AcyI. In another embodiment, the in the method step A) the compounds are selected from a group consisting of: N-acetylcysteine, lysozyme, and β-galactosidase and combinations thereof and a combination comprising N-acetylcysteine and lysozyme is used. In an embodiment, the host cell is first subjected to N-acetylcysteine followed by a treatment of lysozyme, and wherein the host cell is subjected to N-acetylcysteine for 0.5 to 3 days, preferably to 1 to 2 days and is further treated with lysozyme for 3 min. to 1 hour, preferably for 10 min to 30 min, most preferred for 10 to 15 min. In another embodiment, the N-acetylcysteine treatment is carried out at a temperature of 12° C. to 37° C. and the lysozyme treatment is conducted in a temperature range from 20° C. to 37° C., preferably at a temperature range from 20° C. to 30° C. In an embodiment, the concentration of N-acetylcysteine is kept between 0.05 mg/mL and 1 mg/mL and the concentration of lysozyme is between 10 to 60 µg/mL. In another embodiment, in method step B) the recombinant nucleic acid sequence is introduced into the host cell via conjugation or electroporation. In another embodiment, in method step A) the cells are subjected to positively charged polyaminoacids such as poly-L-lysine hydrobromide or poly-L-ornithine hydrochloride or combinations thereof.

In another aspect, a method for transforming cyanobacterial cells having an extracellular polymeric layer (EPS) comprising treating the cells with compounds selected from a group consisting of: N-acetylcysteine, lysozyme, and β-galactosidase and combinations thereof, before and/or during transformation with a recombinant DNA wherein the cyanobacterial cell in addition includes restriction endonucleases and wherein the method further comprises methylating the restriction sites of the recombinant DNA before or during transformation. In an embodiment, the plasmid vector has a first recombinant gene codes for a first enzyme catalyzing a metabolic reaction, which is not present in the wild type host cell and the first recombinant genes is pyruvate decarboxylase gene coding for PDC enzyme as a first enzyme and the second recombinant gene is adh coding for ADH enzyme. In an embodiment, the plasmid vector of any has a transcription terminator is present between the first and second recombinant gene.

In another aspect, a method for introducing a recombinant nucleic acid sequence into a cyanobacterial cell with an extracellular polymeric layer (EPS) comprising the method steps of:

A) subjecting the cyanobacterial cell to compounds increasing the permeability of the extracellular polymeric layer EPS) and cell wall, respectively of the cyanobacterial cell, and B) introducing the recombinant nucleic acid sequence into the cyanobacterial cell. In an embodiment, the cyanobacterial cell is subjected to compounds selected from a group consisting of: N-acetylcysteine, lysozyme, and β-galactosidase and combinations thereof.

In an aspect, a kit for producing a chemical compound via photosynthesis, comprising host including the recombinant gene encoding one protein that is involved in a biosynthetic pathway for the production of the chemical compound, a vessel for culturing the host cells, and means for illumination of the host cells and wherein the host cells are in a transportable form, wherein the host cells are at least in one of the following transportable forms, suspended in a liquid growth medium, in a frozen form, on an agar plate. In another embodiment, the vessel comprises a photobioreactor which is at least partly transparent for the radiation emitted by the means for illumination of the host cells wherein the means for illumination of the host cells comprises lamps or light emitting diodes or a combination thereof.

In an aspect, a genetically enhanced ethanologenic copper inducible ABICyano1 host cell is disclosed wherein the host cell exhibits ethanol production up to 135 days.

In another aspect, a genetically enhanced ethanologenic ABICyano1 host cell is disclosed comprising adh genes that encode for alcohol dehydrogenase enzymes with catalytic properties that result in increased ethanol production relative to the ethanol production of alcohol dehydrogenase from *Synechocystis* sp. PCC 6803. In an embodiment, the genetically enhanced plasmids are derived from endogenous plasmids of the host cell wherein the genetically enhanced plasmids are selected from the group consisting of #1792, #1743, #1744, #1749, #1751, #1817, #1818, #1728, and #1578 and can also comprise multiple copies of pdc genes. In an embodiment, the multiple copies are integrated into the chromosome or into a plasmid within the host cell and can comprise plasmids selected from the group consisting of #1792, #1743, #1744, #1749, #1751, #1817, #1818, #1728, and #1578. In an embodiment, a method for generating knockouts in the genome of ABICyano1 comprising introducing a heterologous polynucleotide construct into a ABICyano1 host cell wherein the heterologous polynucleotide construct comprises flanking regions of about 2 kbp or greater that are homologous to a gene or gene portion in the genome of ABICyano1. In another embodiment, the homologous recombination efficiency is increased through the deletion of a gene homologue in ABICyano1 that encodes for a RecJ homolog selected from the group consisting of orf0488, and orf2384. In yet another embodiment, the knockouts are selected from the group consisting of narB, argH, leuB, a homologue of a Rad54 encoding gene, and ycf37.

In an aspect, the ethanologenic cassette is selected from an ethanologenic cassette selected from a plasmid selected from the group consisting of #1495, #1578, #1580, #1581, #1601, #1606, TK412 and TK411.

In an aspect, a genetically enhanced ethanologenic ABICyano1 host cell is disclosed comprising an ethanologenic cassette comprising adh and pdc genes that are under the control of endogenous metal inducible promoters selected from the group consisting of Porf0128 (SEQ ID NO: 19), Porf1486 (SEQ ID NO: 20), Porf3164 (SEQ ID NO: 21), Porf3293 (SEQ ID NO: 22), Porf3621 (SEQ ID NO: 23), Porf3635 (SEQ ID NO: 24), Porf3858 (SEQ ID NO: 25), Porf1071 (SEQ ID NO: 26), Porf1072 (SEQ ID NO: 27), Porf1074 (SEQ ID NO: 28), Porf1075 (SEQ ID NO: 29), Porf1542 (SEQ ID NO: 30), Porf1823 (SEQ ID NO: 31), Porf1824 (SEQ ID NO: 32), Porf3126 (SEQ ID NO: 33), Porf3389 (SEQ ID NO: 34), Porf0221 (SEQ ID NO: 35), Porf0222 (SEQ ID NO: 36), Porf0223 (SEQ ID NO: 37), Porf0316 (SEQ ID NO: 38), Porf3232 (SEQ ID NO: 39), Porf3461 (SEQ ID NO: 40), and Porf3749 (SEQ ID NO: 41). Porf1071 and Porf3126.

In another aspect, disclosed is a genetically enhanced ethanologenic ABICyano1 host cell comprising a genomic knockout of the flv3 gene wherein the host cell produces more ethanol that the corresponding host cell having an intact flv3 gene. In an embodiment, the production of ethanol is about 10% to about 20% greater than the host cell having an intact flv3 gene. In an embodiment, the plasmid comprises plasmid #1772.

In another aspect, a method for making ethanol is disclosed comprising growing the host cell comprising a genomic knockout of a ycf37 gene and further comprising knocking out a genomic ycf37 gene in an ethanologenic ABICyano1 host cell.

In an aspect, a non-naturally occurring ethanologenic *Cyanobacterium* sp. ABICyano1 organism is disclosed wherein the promoter operably linked to an adh gene and the promoter operably linked to a pdc gene are selected from the group consisting of PrbcLS, PntcA, PnblA, PisiA, PpetJ, PpetE, PcorT, PsmtA, PziaA, PsigB, PlrtA, PhtpG, PhspA, PclpB1, PhliB, PggpS, PpsbA2, PpsaA, PnirA, PnarB, PnrtA, PisiB, PnrsB, PlrtA, PmrgA, PpstS, and PcrhC, PpetJ, PpsbD, PnblA, PrpoA, PisiB, PnblA, PisiA, PpetJ, PpetE, PcorT, PsmtA, PziaA, PsigB, PlrtA, PhtpG, PhspA, PclpB1, PhliB, PggpS, PpsbA2, PpsaA, PnirA, PnarB, PnrtA, PcrhC, PrbcL, PrnpA, PrpsL, PrpoA, PpsaA, PpsbA2, PpsbD, PcpcB, PhspA, PclpB1, PbliB, PnirA*2, PnirA*3, PnirA*4, PmntC, PrpsL*4, Prbc*, PcpcB, PrpsL*4, PcpcB (SEQ ID NO: 9), PnirA (SEQ ID NO: 10), PlrtA (SEQ ID NO: 11), PmrgA (SEQ ID NO: 12), PnblA (SEQ ID NO: 13), PggpS (SEQ ID NO: 14), PpetJ (SEQ ID NO: 15), PppsA (SEQ ID NO: 16), PrnpA (SEQ ID NO: 17), PpstS (SEQ ID NO: 18), Porf0128 (SEQ ID NO: 19), Porf1486 (SEQ ID NO: 20), Porf3164 (SEQ ID NO: 21), Porf3293 (SEQ ID NO: 22), Porf3621 (SEQ ID NO: 23), Porf3635 (SEQ ID NO: 24), Porf3858 (SEQ ID NO: 25), Porf1071 (SEQ ID NO: 26), Porf1072 (SEQ ID NO: 27), Porf1074 (SEQ ID NO: 28), Porf1075 (SEQ ID NO: 29), Porf1542 (SEQ ID NO: 30), Porf1823 (SEQ ID NO: 31), Porf1824 (SEQ ID NO: 32), Porf3126 (SEQ ID NO: 33), Porf3389 (SEQ ID NO: 34), Porf0221 (SEQ ID NO: 35), Porf0222 (SEQ ID NO: 36), Porf0223 (SEQ ID NO: 37), Porf0316 (SEQ ID NO: 38), Porf3232 (SEQ ID NO: 39), Porf3461 (SEQ ID NO: 40), Porf3749, and (SEQ ID NO: 41). In an embodiment, the promoter operably linked to an adh gene and the promoter operably linked to a pdc gene are selected from the group consisting of Porf0128, Porf1486, Porf3164, Porf3293, Porf3621, Porf3635, Porf1071, Porf1072, Porf1074, Porf1075, Porf1542, Porf1823, Porf3126, Porf0221, Porf0222, Porf0223, Porf0316, Porf3126, Porf3232, Porf3461, and Porf3749. In another embodiment, the non-naturally occurring ethanologenic *Cyanobacterium* sp. ABICyano1 organism contains a promoter operably linked to an adh gene and the promoter operably linked to a pdc gene are selected from a polynucleotide sequence having at least 90% identity to a polynucleotide sequence selected from the group consisting of PrbcLS, PntcA, PnblA, PisiA, PpetJ, PpetE, PcorT, PsmtA, PziaA, PsigB, PlrtA, PhtpG, PhspA, PclpB1, PhliB, PggpS, PpsbA2, PpsaA, PnirA, PnarB, PnrtA, PisiB, PnrsB, PlrtA, PmrgA, PpstS, and PcrhC, PpetJ, PpsbD, PnblA, PrpoA, PisiB, PnblA, PisiA, PpetJ, PpetE, PcorT, PsmtA, PziaA, PsigB, PlrtA, PhtpG, PhspA, PclpB1, PhliB, PggpS, PpsbA2, PpsaA, PnirA, PnarB, PnrtA, PcrhC, PrbcL, PrnpA, PrpsL, PrpoA, PpsaA, PpsbA2, PpsbD, PcpcB, PhspA, PclpB1, PhliB, PnirA*2, PnirA*3, PnirA*4, PmntC, PrpsL*4, Prbc*, PcpcB, PrpsL*4, PcpcB (SEQ ID NO: 9) PnirA (SEQ ID NO: 10), PlrtA (SEQ ID NO: 11), PmrgA (SEQ ID NO: 12), PnblA (SEQ ID NO: 13), PggpS (SEQ ID NO: 14), PpetJ (SEQ ID NO: 15), PppsA (SEQ ID NO: 16), PrnpA (SEQ ID NO: 17), PpstS (SEQ ID NO: 18), Porf0128 (SEQ ID NO: 19), Porf1486 (SEQ ID NO: 20), Porf3164 (SEQ ID NO: 21), Porf3293 (SEQ ID NO: 22), Porf3621 (SEQ ID NO: 23), Porf3635 (SEQ ID NO: 24), Porf3858 (SEQ ID NO: 25), Porf1071 (SEQ ID NO: 26), Porf1072 (SEQ ID NO: 27), Porf1074 (SEQ ID NO: 28), Porf1075 (SEQ ID NO: 29), Porf1542 (SEQ ID NO: 30), Porf1823 (SEQ ID NO: 31), Porf1824 (SEQ ID NO: 32), Porf3126 (SEQ ID NO: 33), Porf3389 (SEQ ID NO: 34), Porf0221 (SEQ ID NO: 35), Porf0222 (SEQ ID NO: 36), Porf0223 (SEQ ID NO: 37), Porf0316 (SEQ ID NO: 38), Porf3232 (SEQ ID NO: 39), Porf3461 (SEQ ID NO: 40), Porf3749, and (SEQ ID NO: 41). In another embodiment, the non-naturally occurring ethanologenic *Cyanobacterium* sp. ABICyano1 organism contains a genetically enhanced plasmid that is selected from the group consisting of TK293, TK441, TK480, TK481, TK482, TK483, TK484, TK485, TK486, TK487, TK488, TK489, TK490, TK491, TK492, TK493, TK500, TK501, TK502, TK503, TK504, TK527, TK528, TK529, #1581, #1578, TK368, #1495, #1606, #1629, #1636, #1631, #1632, #1580, #1601, #1606, TK411, and TK412.

BRIEF DESCRIPTION OF THE DRAWINGS

FIG. 5 depicts a sequence comparison of 16S rDNA of ABICyano1 (SEQ ID NO: 133) with 16S rDNA from other *Cyanobacterium* species including Cyano10216 (SEQ ID NO: 130), CyanoETS-03 (SEQ ID NO: 131), ABICyano2 (SEQ ID NO: 132), CyanoLLi5 (SEQ ID NO: 134), Cyano7202 (SEQ ID NO: 135).

FIG. 24 depicts a sequence comparison between the native promoter nirA (SEQ ID NO: 10) from ABICyano1 and different variants (promoter nirA*2 (SEQ ID NO: 136); promoter nirA*3 (SEQ ID NO: 137); promoter nirA*4 (SEQ ID NO: 138)) of the promoter harboring nucleotide changes in the ribosomal binding site, the binding sites for the regulators NtcA and NtcB and the TATA box.

FIG. 27 depicts a nucleotide sequence comparison between the native smtA promoter from Synechococcus PCC 7002 (SEQ ID NO: 144) and two different variants of the promoter, (PsmtA*1 (SEQ ID NO: 145); and Psmt*2 (SEQ ID NO: 146)_containing mutations in the ribosomal binding site.

FIG. 51 depicts sequence information and annotation of endogenous copper inducible promoters Porf0316 (SEQ ID NO: 147), Porf3461 (SEQ ID NO: 148, and zinc inducible promoters Porf3126 (SEQ ID NO: 149), Porf1071 (SEQ ID NO: 150) (also repressible by manganese).

FIG. 104 depicts the results of various transformation experiments via homologous recombination (HR) events in ABICyano1.

FIG. 113 depicts data for various transformation experiments via homologous recombination.

FIG. 115 depicts PCR-based segregation analysis shows that an ABICyano1 organism transformed with construct TK616 (pOriVT_ycf37-up_FRT-PcpcB-Gm-ter-FR-T_ycf37-down) successfully integrated an antibiotic resistance marker gene (Gm) into to the ycf37 gene in the chromosome of ABICyano1 and confirms complete segregation of TK616.5 for all chromosome copies.

FIG. 116 depicts PCR-based segregation analysis shows that an ABICyano1 organism transformed with construct TK597 (pOriVT_argH-up_FRT-PcpcB-Gm-ter-FR-T_argH-down) successfully integrated an antibiotic resistance marker gene (Gm) into to the argH gene in the chromosome of ABICyano1. FIG. 116 also depicts auxotrophy for arginine of the ABICyano1 TK597 strains tested by growing on a BG11 agarose plate lacking arginine.

FIG. 120 depicts a plasmid map of #1697 (pABIcyano1-PnirA*3-zmDC(opt3)-dsr-Prbc*(optRBS)-synADHoop).

FIG. 121 depicts copper-promoter variants with improved RBS_including Porf221* (SEQ ID NO: 151), Porf0223* (SEQ ID NO: 152), Porf 0316* (SEQ ID NO: 153).

FIG. 122 depicts copper-promoter variants with improved −10 region including Porf0221 with improved −10 region (SEQ ED NO: 154), Porf0223 with improved −10 region (SEQ ID NO: 155), and Porf0316 with improved −10 region (SEQ ID NO: 156).

FIG. 123 depicts optimized Porf3126* (PsmtA) (SEQ ID NO: 157) promoter variant derived from ABICyano1 Porf3126 (SEQ ID NO: 149) used to control PDC activity in construct TK490.

FIG. 124 depicts PDC activity in $Zn^{2+}$ induced ABICyano1 strains TK490 and #1762.

FIG. 125 depicts a plasmid map with sequence annotation of plasmid #1646 (pABIcyano1-PnirA-zmPDC(opt1)dsrA-Prbc*(optRBS)-ADH111(opt)_ter).

FIG. 126 depicts a plasmid map with sequence annotation of plasmid #1762 (pABIcyano1-Porf3126*-zmPDC(opt1) dsrA-Prbc*(optRBS)-ADH111(opt)\ter.

FIG. 127 depicts a plasmid map with sequence annotation of plasmid #1753 (pABIcyano1-PnirA-zmPDC(opt1)_dsrA-Prbc*(optRBS)-Adh111_ter).

FIG. 128 depicts a plasmid map with sequence annotation of plasmid #1754 (pABIcyano1-PnirA-zmPDC(opt1)-dsrA-Prbc*(optRBS)-ADH242(opt)_ter).

FIG. 129 depicts a plasmid map with sequence annotation of plasmid #1735 (pABIcyano1-PnirA-zmPDC(opt1)_dsrA-Prbc*(optRBS)-Adh1694_ter).

FIG. 130 depicts a plasmid map with sequence annotation of plasmid #1749 (pABIcyano1-PnirA-zmPDC(opt3)-dsrA-PrpsL*4-synADHoop).

FIG. 131 depicts a plasmid map with sequence annotation of plasmid #1790 (pABIcyano1-PnirA-zmPDC(opt3)\dsrA-PcpcB-ADH242(opt)_trbcS).

Figure 132:
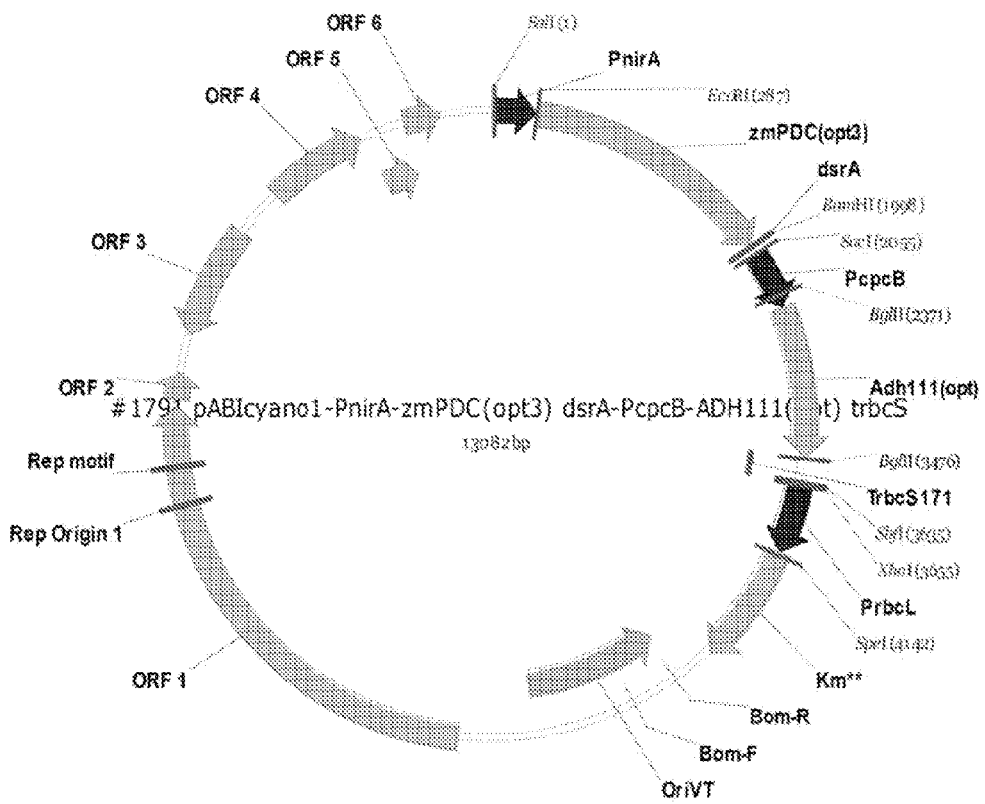

FIG. 132 depicts a plasmid map with sequence annotation of plasmid #1791 (pABIcyano1-PnirA-zmPDC(opt3)\dsrA-PcpcB-ADH111(opt)_trbcS).

Figure 133:
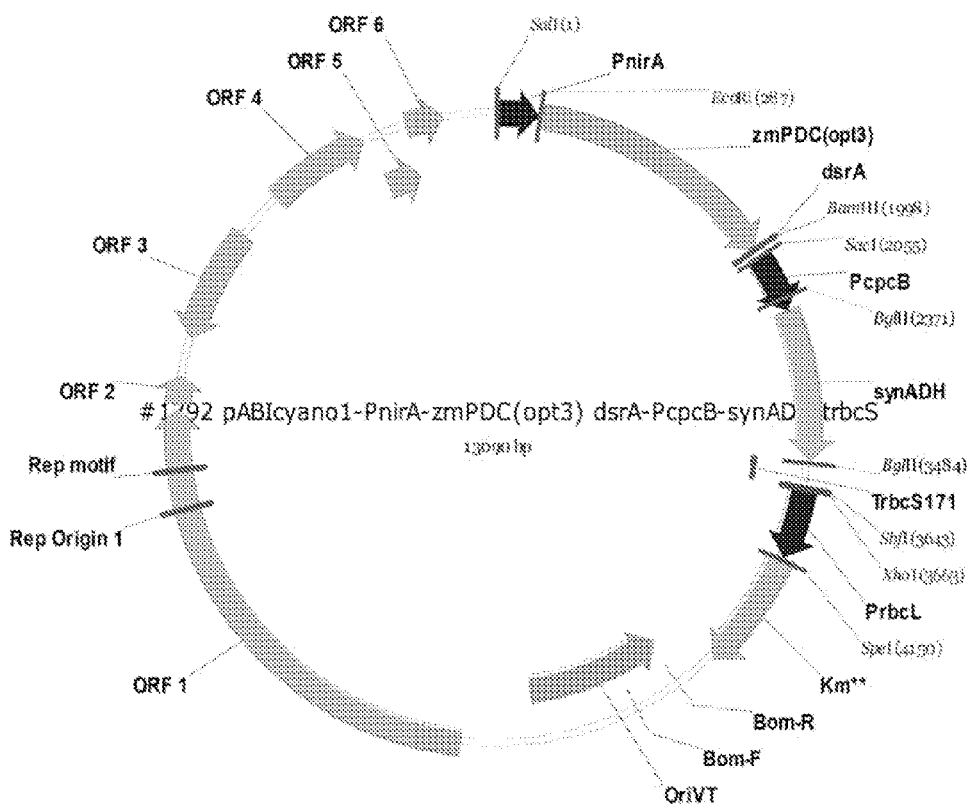

FIG. 133 depicts a plasmid map with sequence annotation of plasmid #1792 (pABIcyano1-PnirA-zmPDC(opt3)\dsrA-PcpcB-synADH_trbcS).

Figure 134:
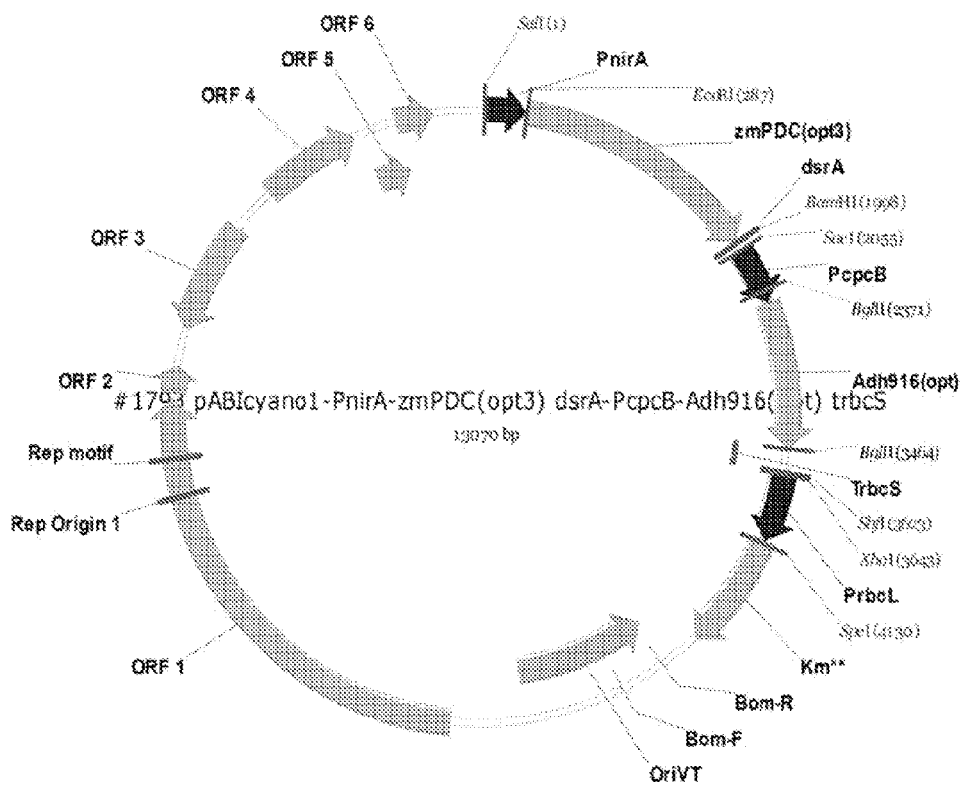

FIG. 134 depicts a plasmid map with sequence annotation of plasmid #1793 (pABIcyano1-PnirA-zmPDC(opt3)\dsrA-PcpcB-Adh916(opt)_trbcS).

Figure 135:
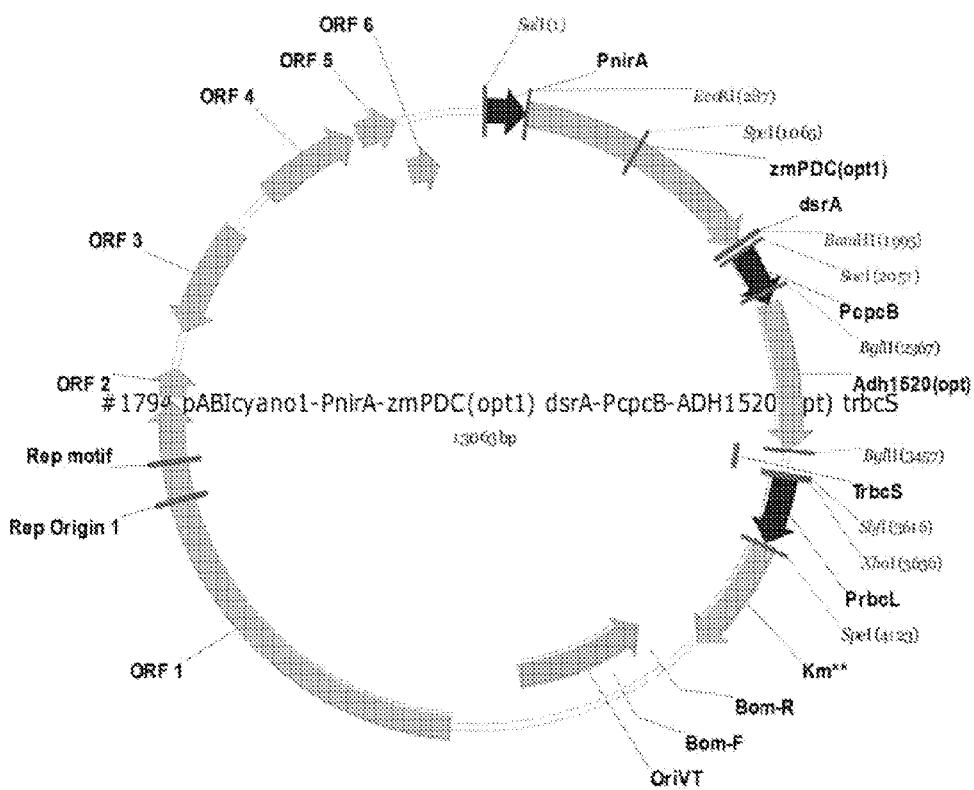

FIG. 135 depicts a plasmid map with sequence annotation of plasmid #1794 (pABIcyano1-PnirA-zmPDC(opt1)\dsrA-PcpcB-ADH1520(opt)_trbcS).

Figure 136:
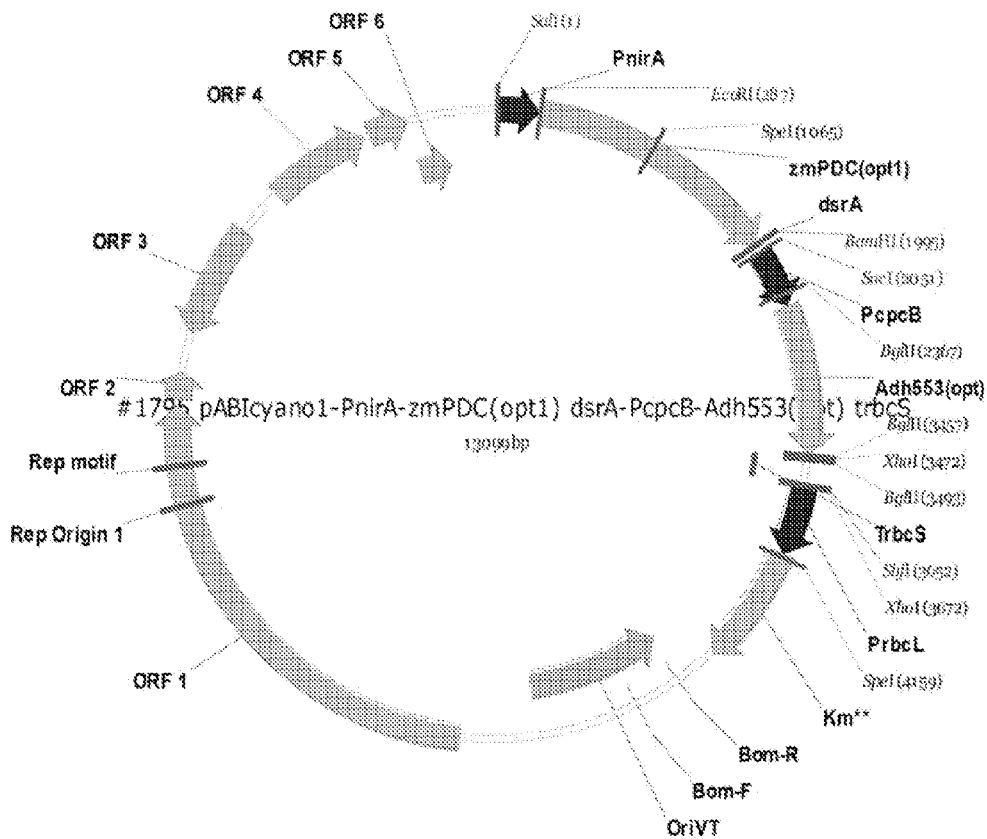

FIG. 136 depicts a plasmid map with sequence annotation of plasmid #1795 (pABIcyano1-PnirA-zmPDC(opt1)\dsrA-PcpcB-Adh553(opt)_trbcS).

Figure 137:
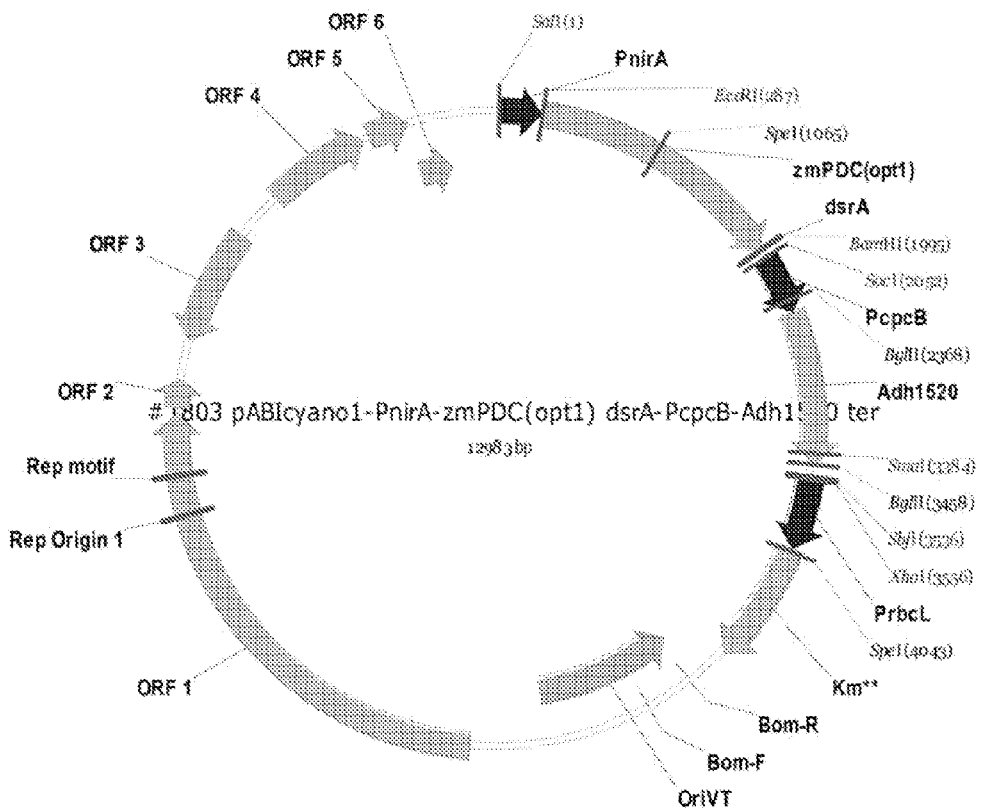

FIG. 137 depicts a plasmid map with sequence annotation of plasmid #1803 (pABIcyano1-PnirA-zmPDC(opt1)\dsrA-PcpcB-Adh1520_ter).

Figure 138:
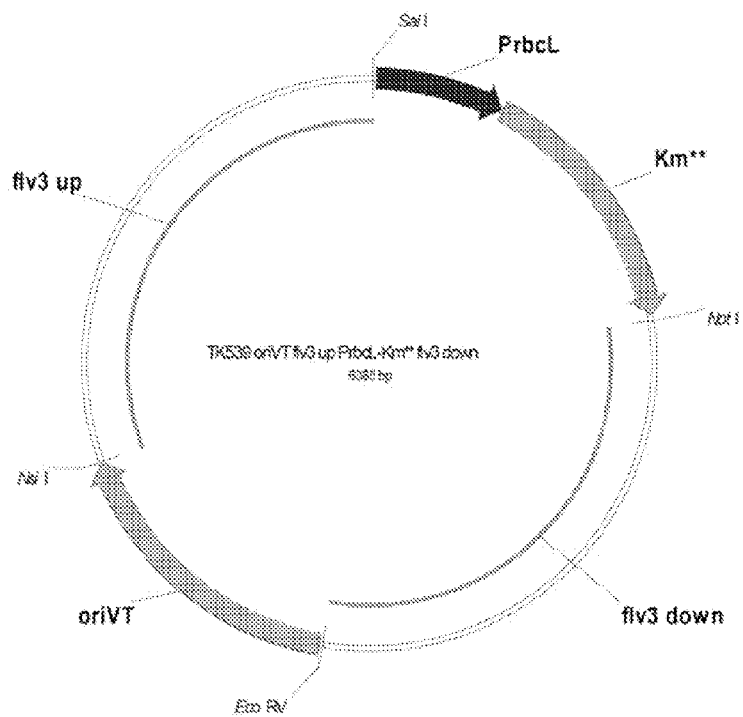

FIG. 138 depicts a plasmid map with sequence annotation of plasmid TK539 (oriVT_flv3_up_PrbcL-Km**_flv3_down).

Figure 139:
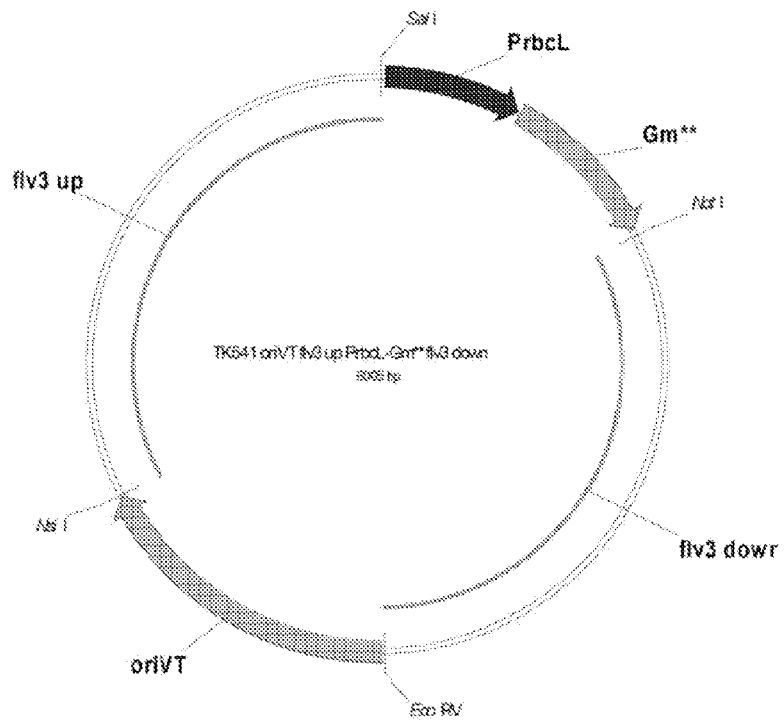

FIG. 139 depicts a plasmid map with sequence annotation of plasmid TK541 (oriVT_flv3_up_PrbcL-Gm**_flv3_down).

Figure 140:
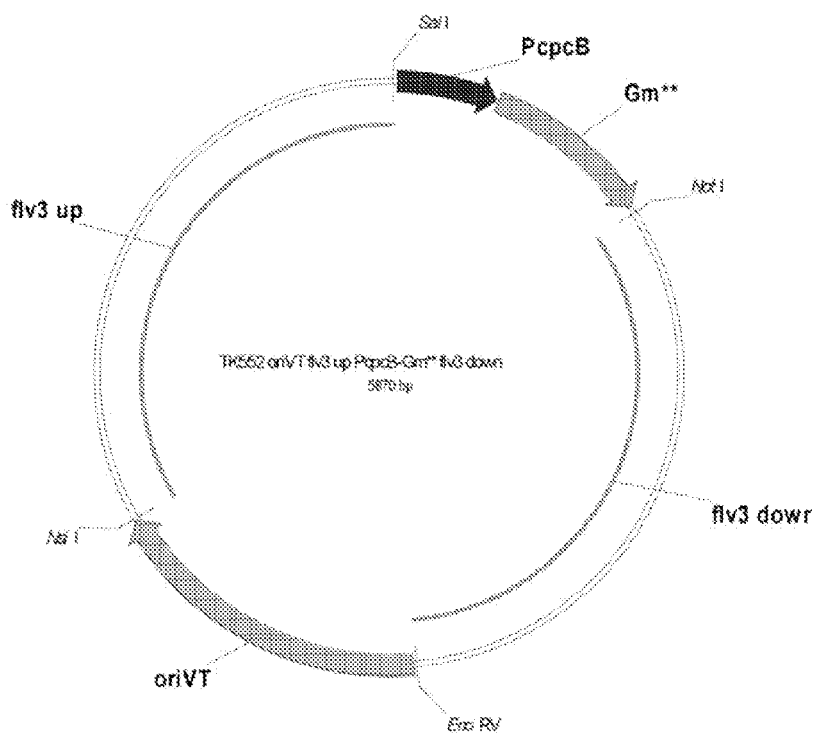

FIG. 140 depicts a plasmid map with sequence annotation of plasmid TK552 (oriVT_flv3_up_PcpcB-Gm**_flv3_down).

Figure 141:
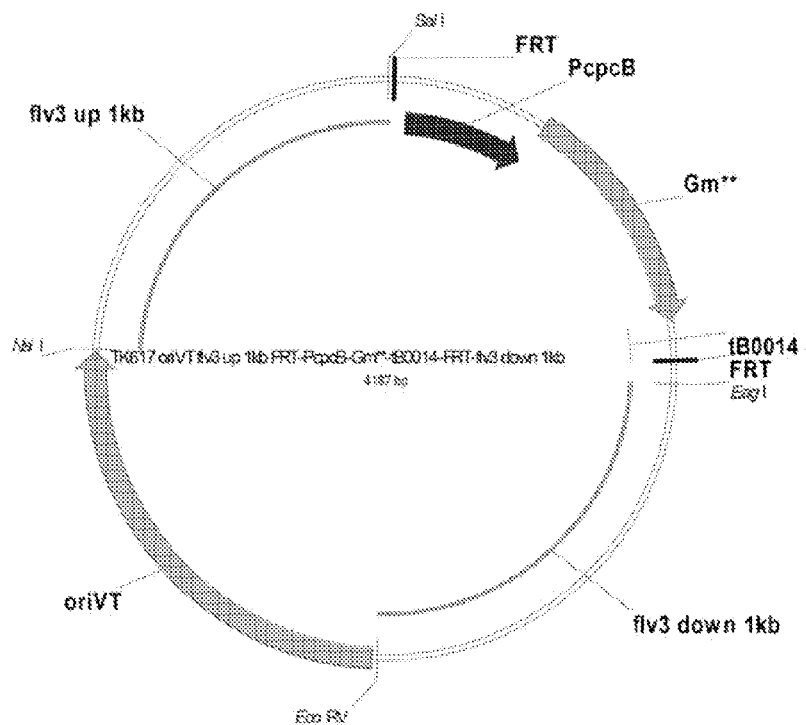

FIG. 141 depicts a plasmid map with sequence annotation of plasmid TK617 (oriVT_flv3_up__1kb_FRT-PcpcB-Gm**-tB0014-FRT-flv3_down__1kb).

Figure 142:
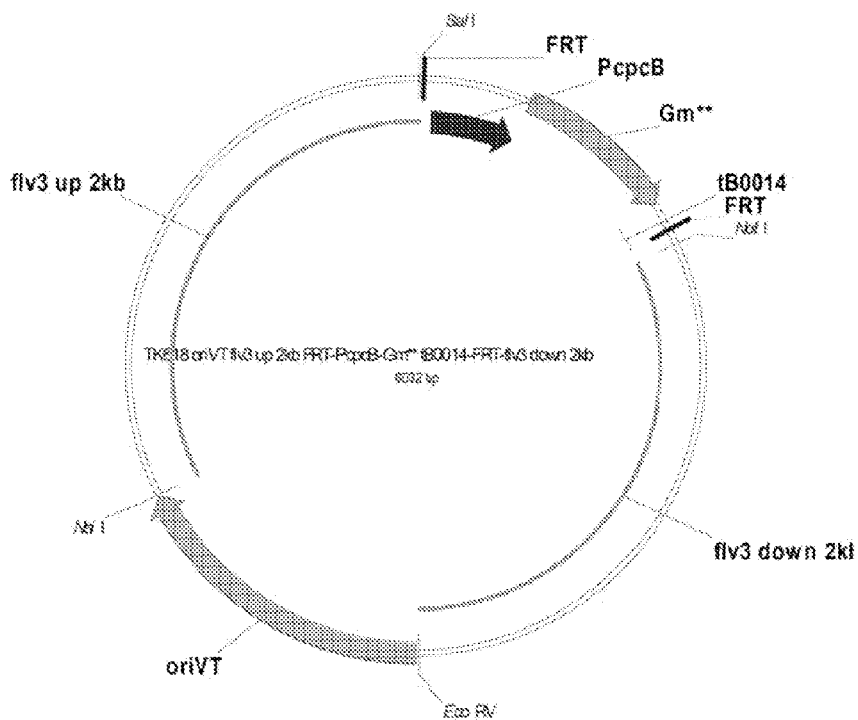

FIG. 142 depicts a plasmid map with sequence annotation of plasmid TK618 (oriVT_flv3_up__2kb_FRT-PcpcB-Gm**-tB0014-FRT-flv3_down__2kb).

Figure 143:
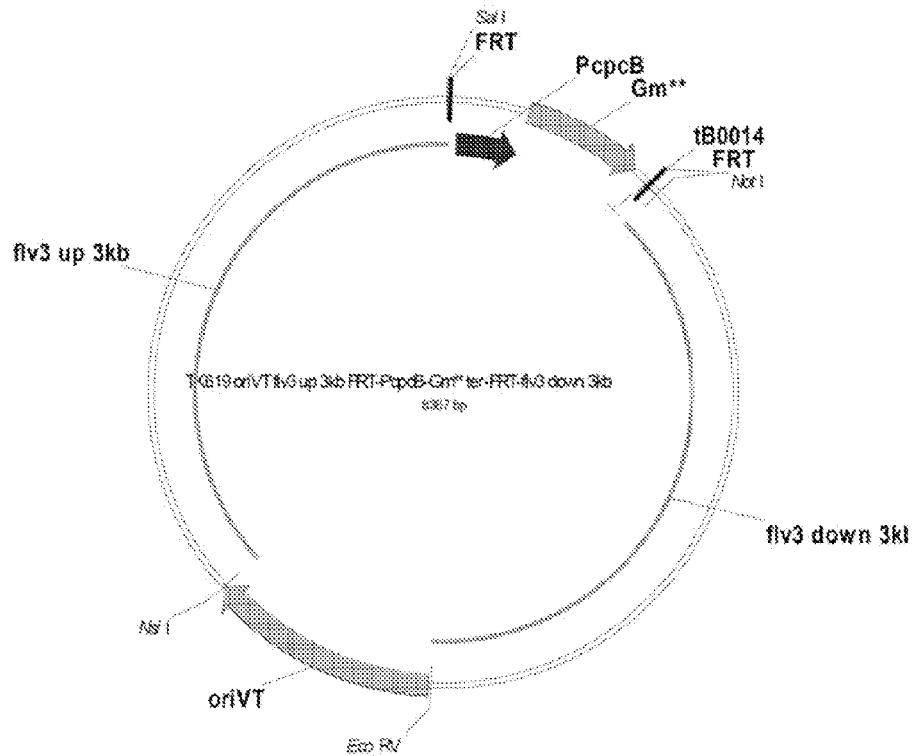

FIG. 143 depicts a plasmid map with sequence annotation of plasmid TK619 (oriVT_flv3_up__3kb_FRT-PcpcB-Gm**_ter-FRT-flv3_down__3kb).

Figure 144:
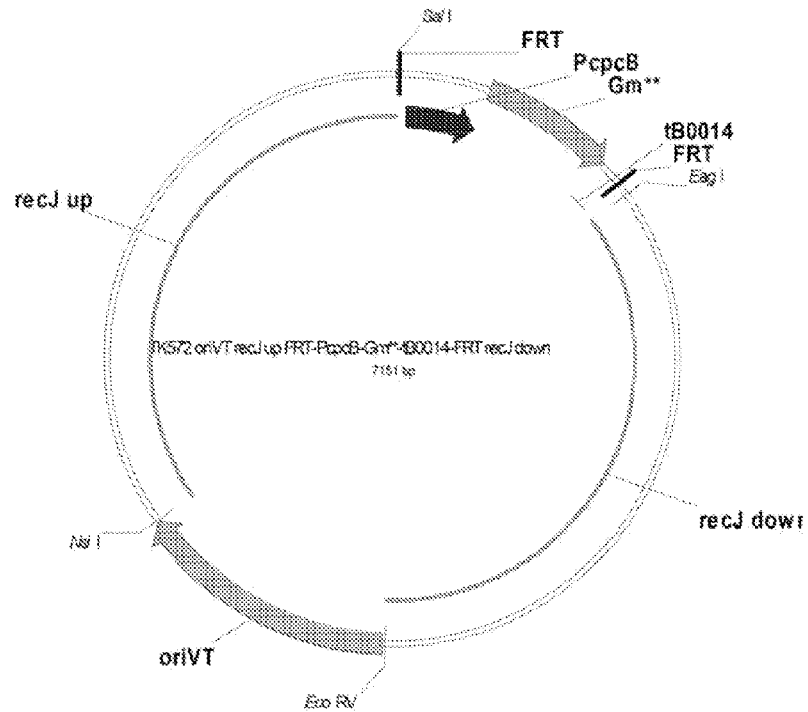

FIG. 144 depicts a plasmid map with sequence annotation of plasmid TK572 (oriVT_recJ_up_FRT-PcpcB-Gm**-tB0014-FRT_recJ_down).

Figure 145:
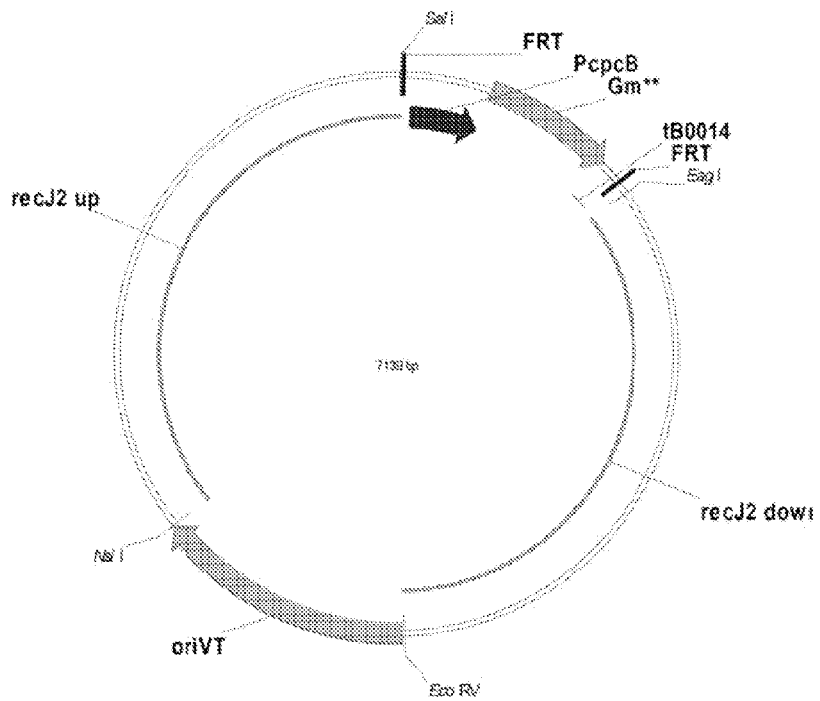

FIG. 145 depicts a plasmid map with sequence annotation of plasmid TK567 (oriVT_recJ2_up_FRT-PcpcB-Gm**-tB0014-FRT_recJ2_down).

Figure 146:
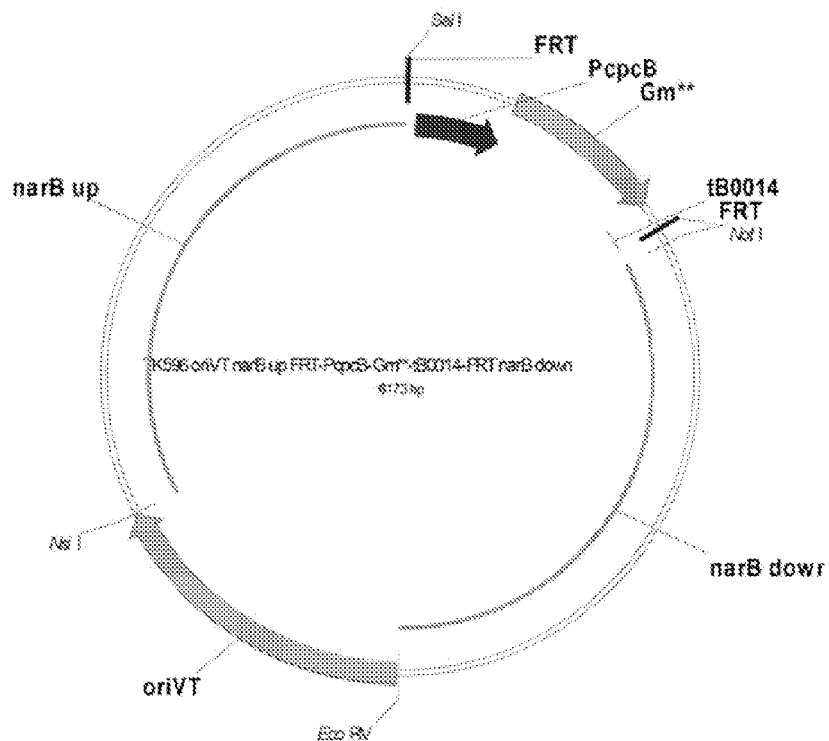

FIG. 146 depicts a plasmid map with sequence annotation of plasmid TK596 (oriVT_narB_up_FRT-PcpcB-Gm**-tB0014-FRT_narB _down).

Figure 147:
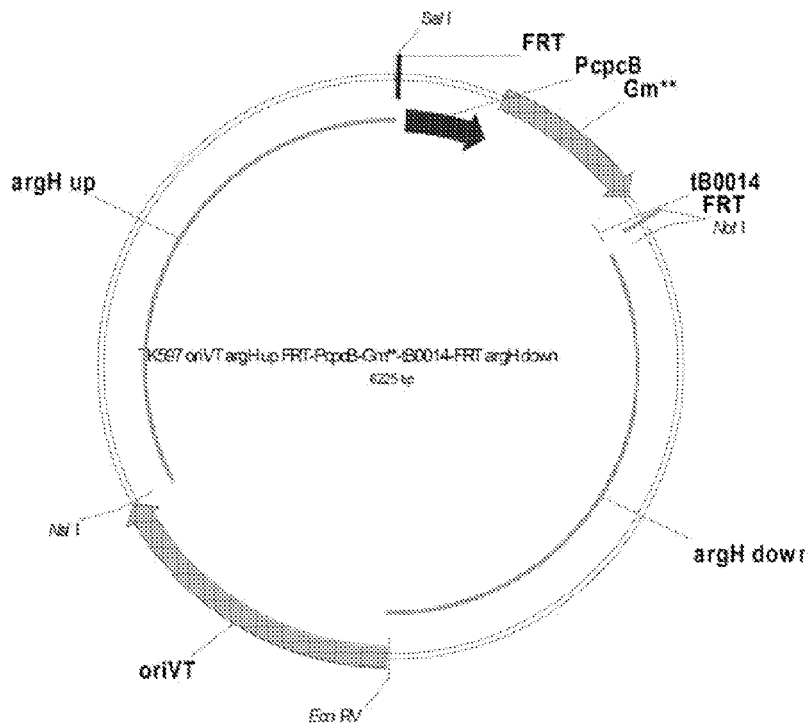

FIG. 147 depicts a plasmid map with sequence annotation of plasmid TK597 (oriVT_argH_up_FRT-PcpcB-Gm**-tB0014-FRT_argH_down .

Figure 148:
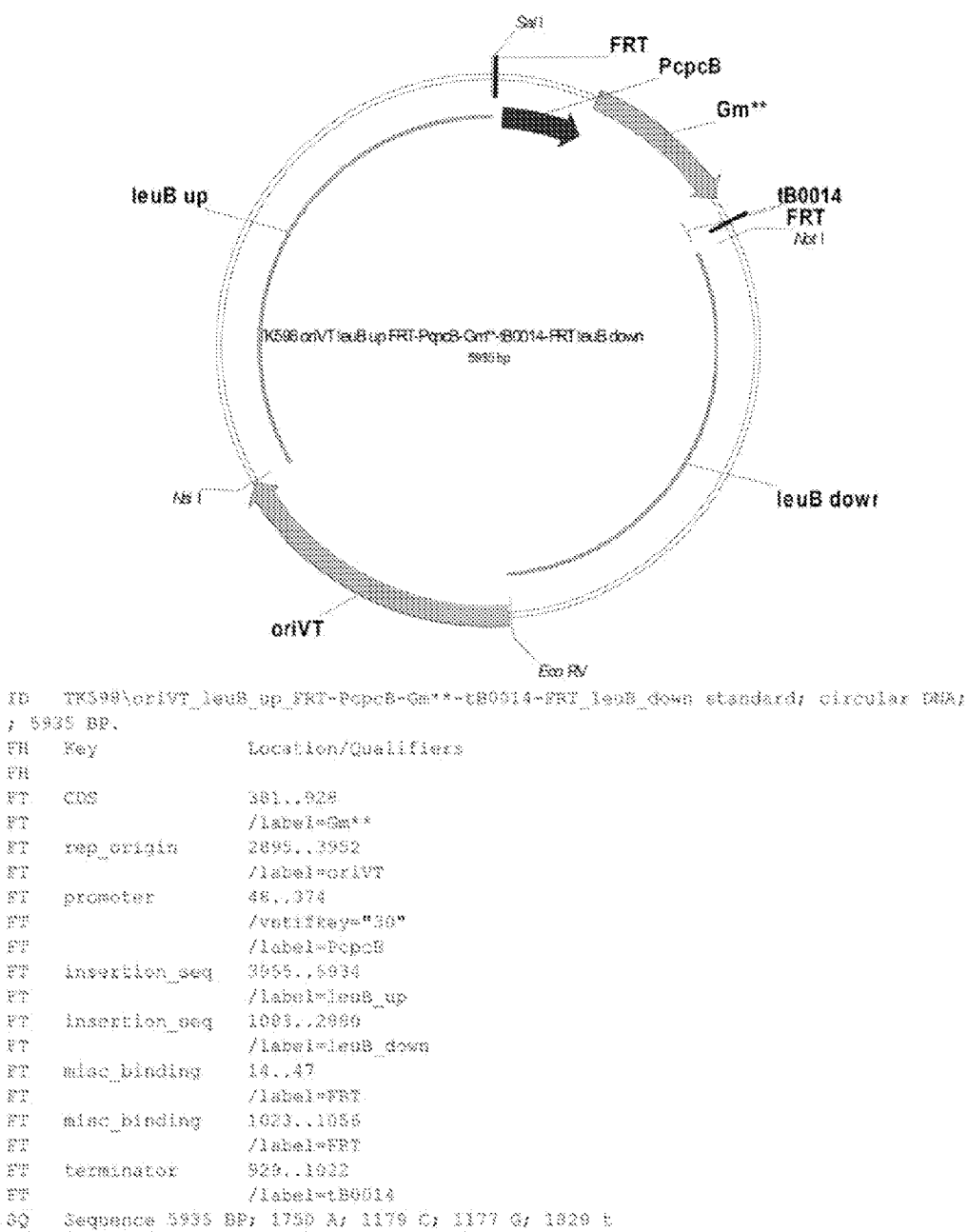

FIG. 148 depicts a plasmid map with sequence annotation of plasmid TK598 (oriVT_leuB_up_FRT-PcpcB-Gm**-tB0014-FRT_leuB_down).

Figure 149:
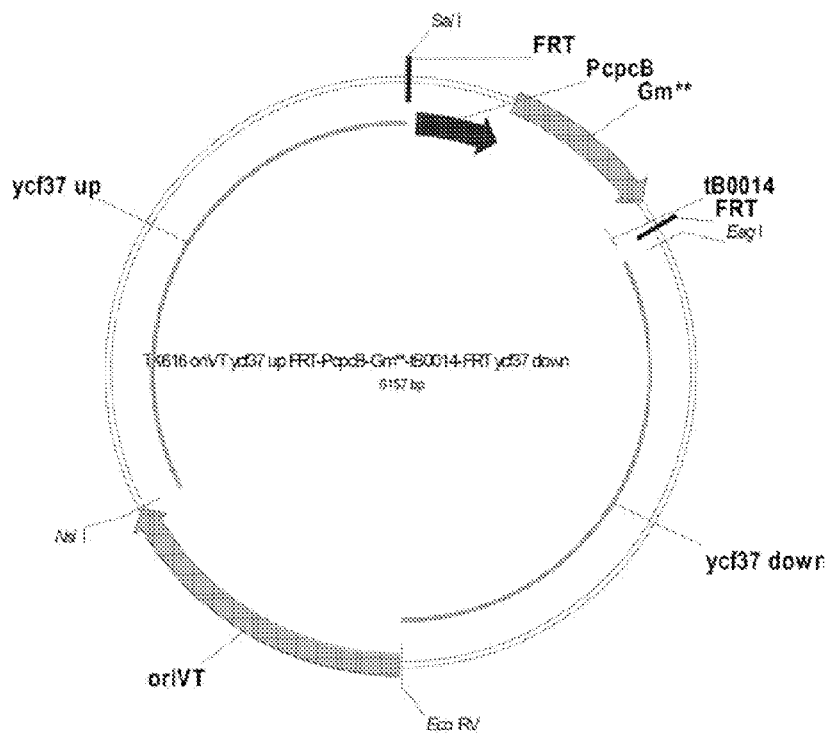

FIG. 149 depicts a plasmid map with sequence annotation of plasmid TK616 (oriVT_ycf37_up_FRT-PcpcB-Gm**-tB0014-FRT_ycf37_down).

Figure 150:
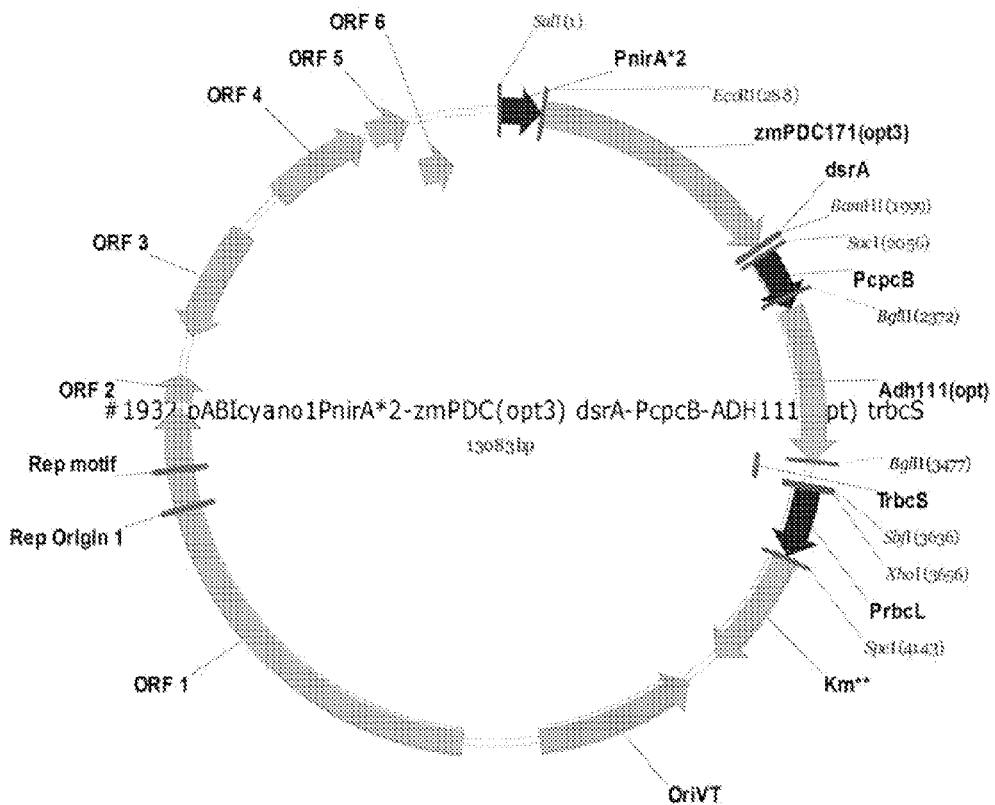

FIG. 150 depicts a plasmid map with sequence annotation of plasmid #1932 (pABIcyano1PnirA*2-zmPDC(opt3)\dsrA-PcpcB-ADH111(opt)_trbcS).

Figure 151:
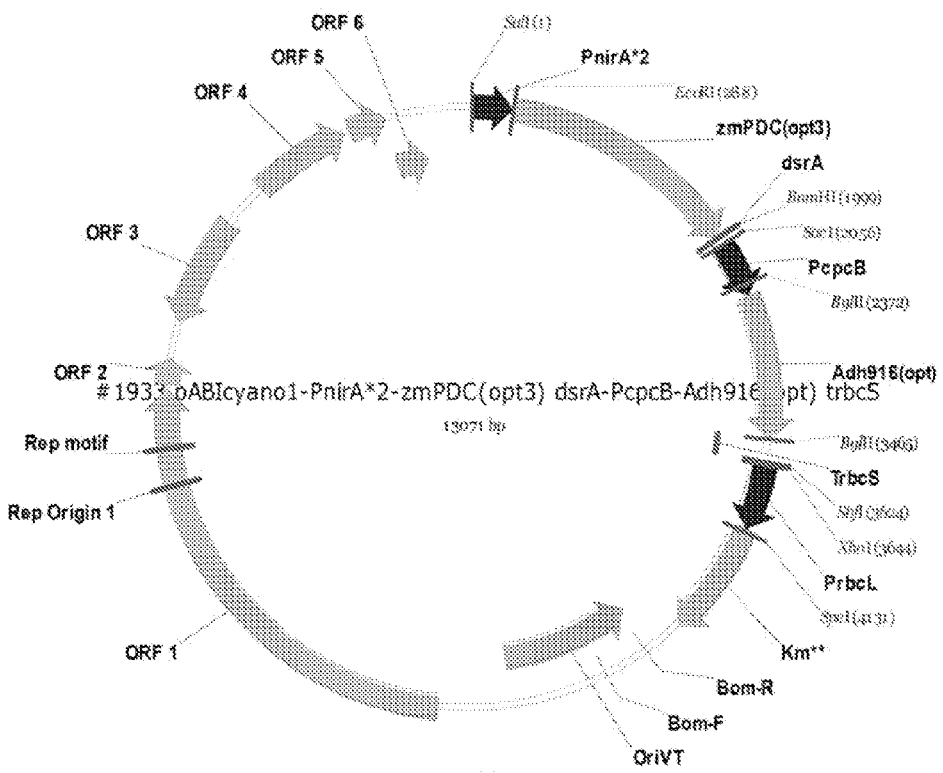

FIG. 151 depicts a plasmid map with sequence annotation of plasmid #1933 (pABIcyano1-PnirA*2-zmPDC(opt3)\dsrA-PcpcB-Adh916(opt)_trbcS).

Figure 152:
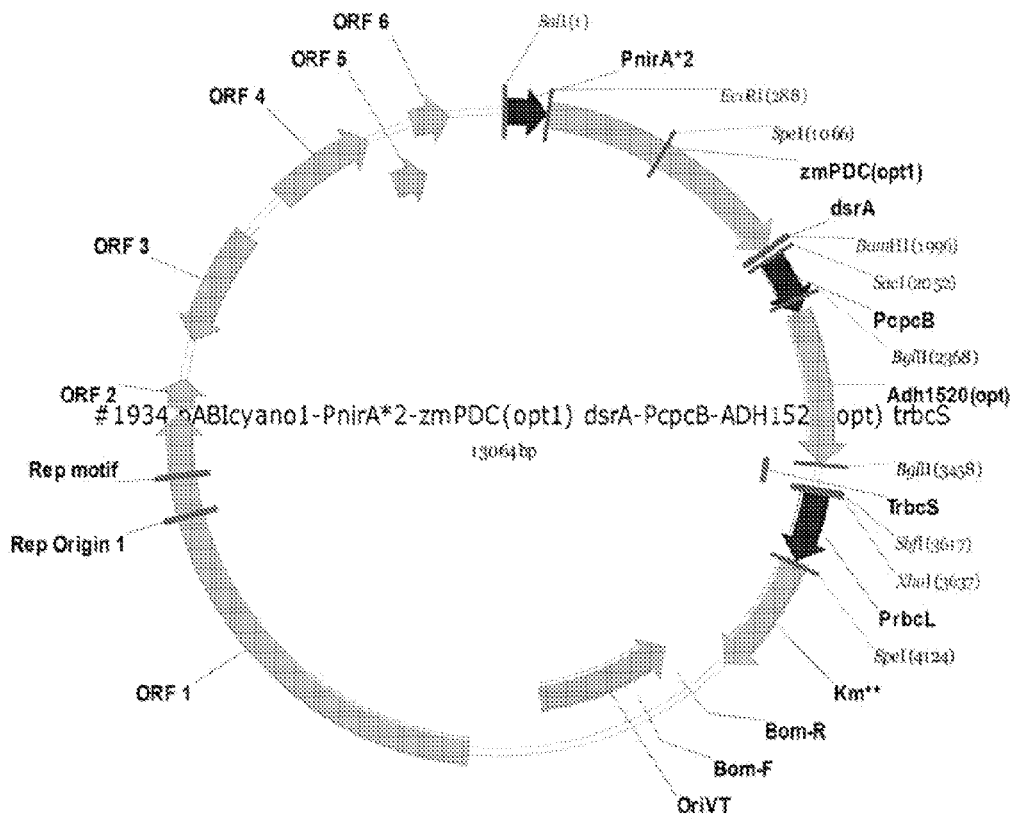

FIG. 152 depicts a plasmid map with sequence annotation of plasmid #1934 (pABIcyano1-PnirA*2-zmPDC(opt1)\dsrA-PcpcB-ADH1520(opt)_trbcS).

Figure 153:
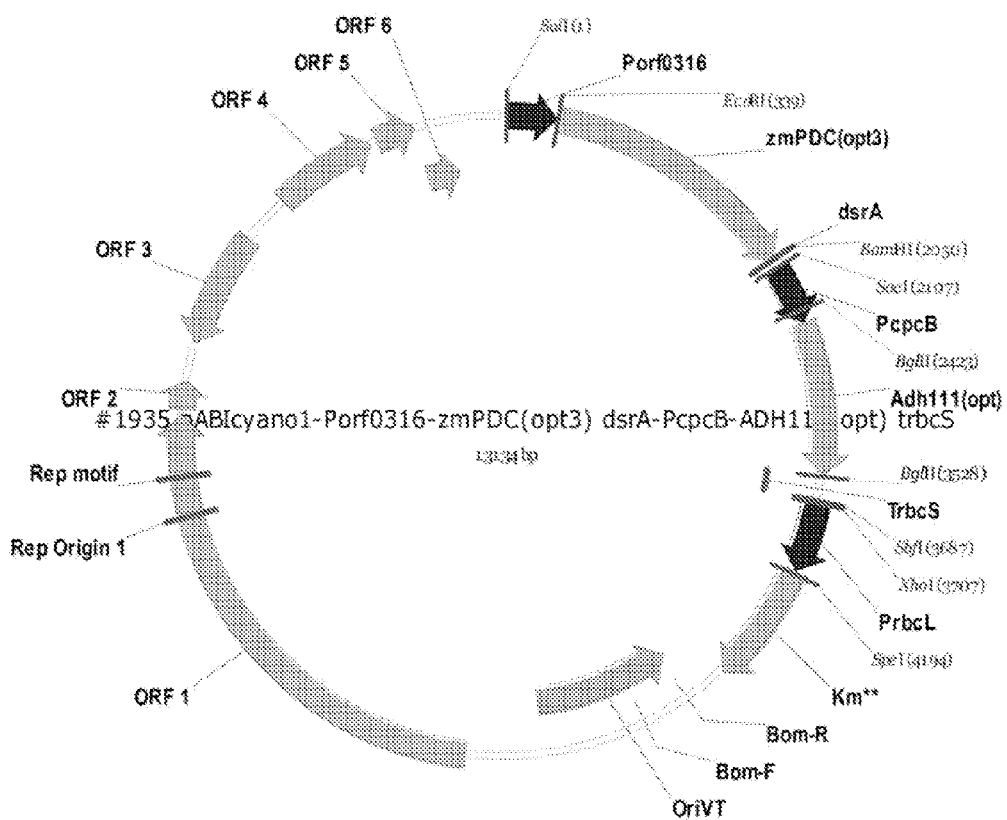

FIG. 153 depicts a plasmid map with sequence annotation of plasmid #1935 (pABIcyano1-Porf0316-zmPDC(opt3)\dsrA-PcpcB-ADH111(opt)_trbcS).

Figure 154:
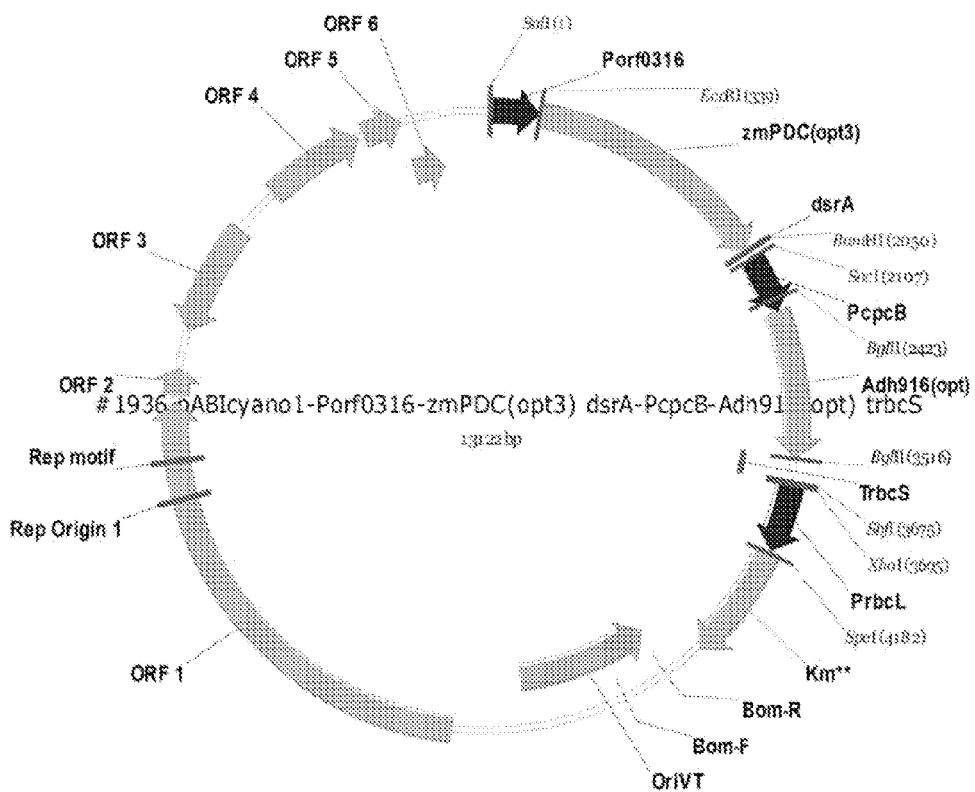

FIG. 154 depicts a plasmid map with sequence annotation of plasmid #1936 (pABIcyano1-Porf0316-zmPDC(opt3)\dsrA-PcpcB-Adh916(opt)_trbcS).

Figure 155:
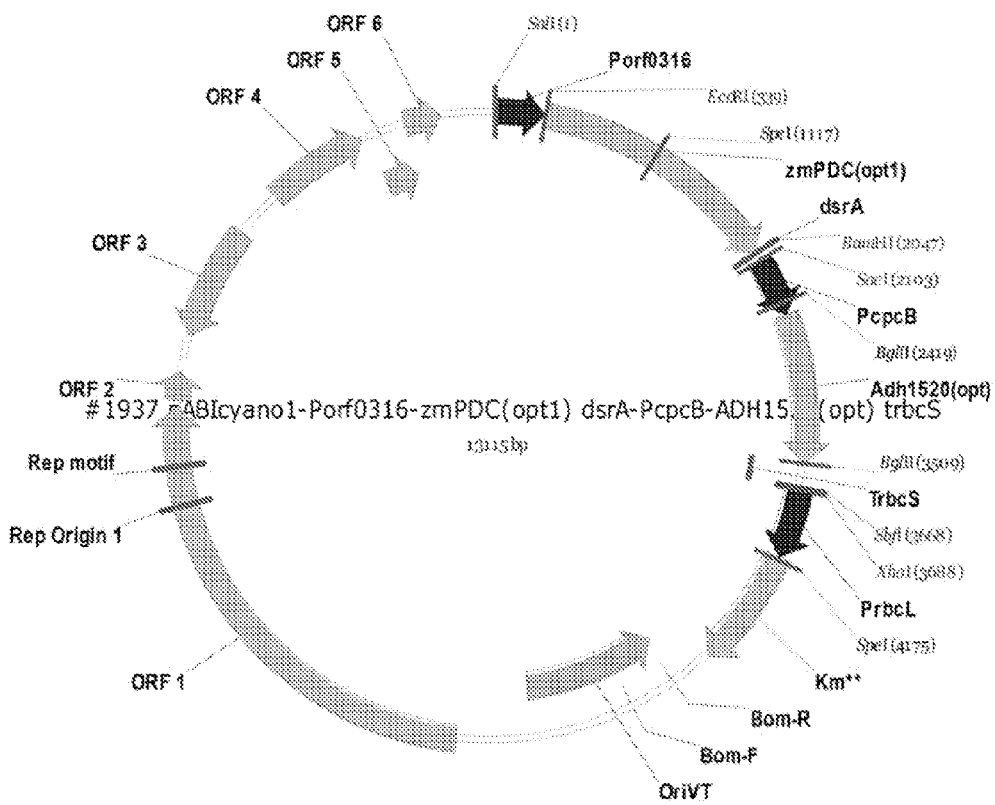

FIG. 155 depicts a plasmid map with sequence annotation of plasmid #1937 (pABIcyano1-Porf0316-zmPDC(opt1)\dsrA-PcpcB-ADH1520(opt)_trbcS).

Figure 156:
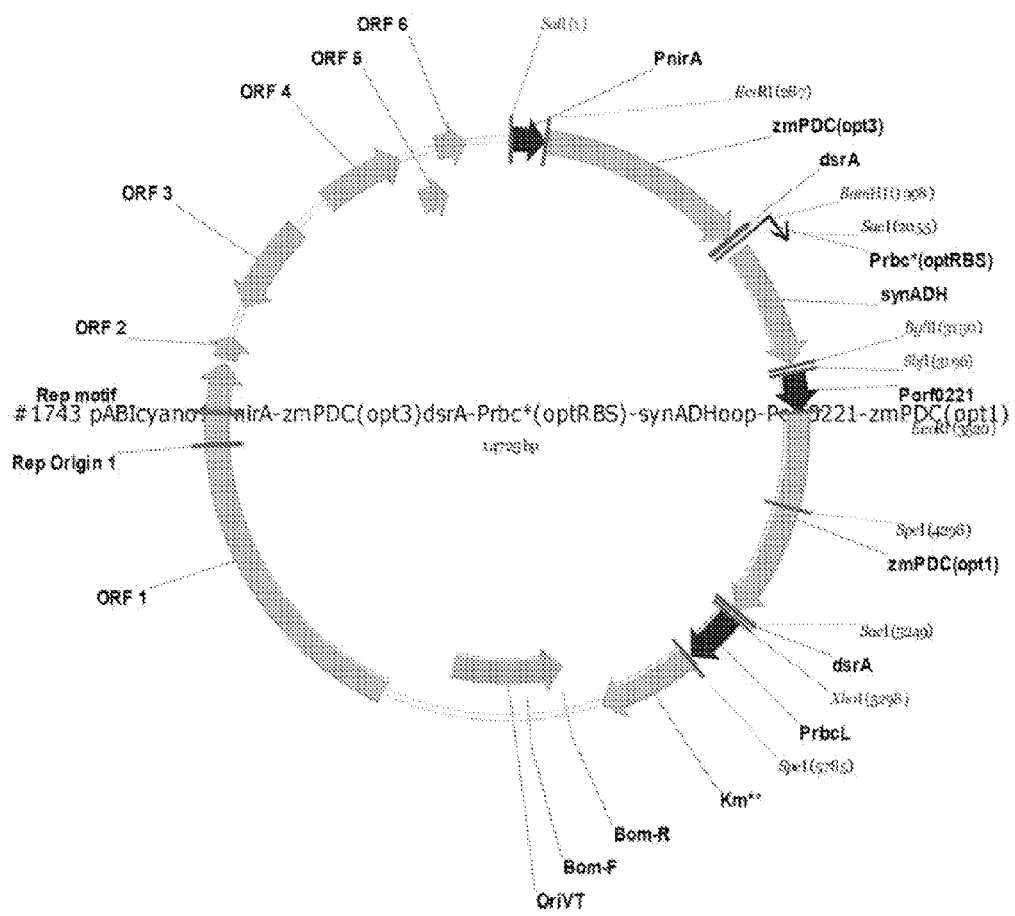

FIG. 156 depicts a plasmid map with sequence annotation of plasmid #1743 (pABIcyano1-PnirA-zmPDC(opt3)dsrA-Prbc*(optRBS)-synADHoop-Porf0221-zmPDC(opt1)dsrA).

Figure 157:
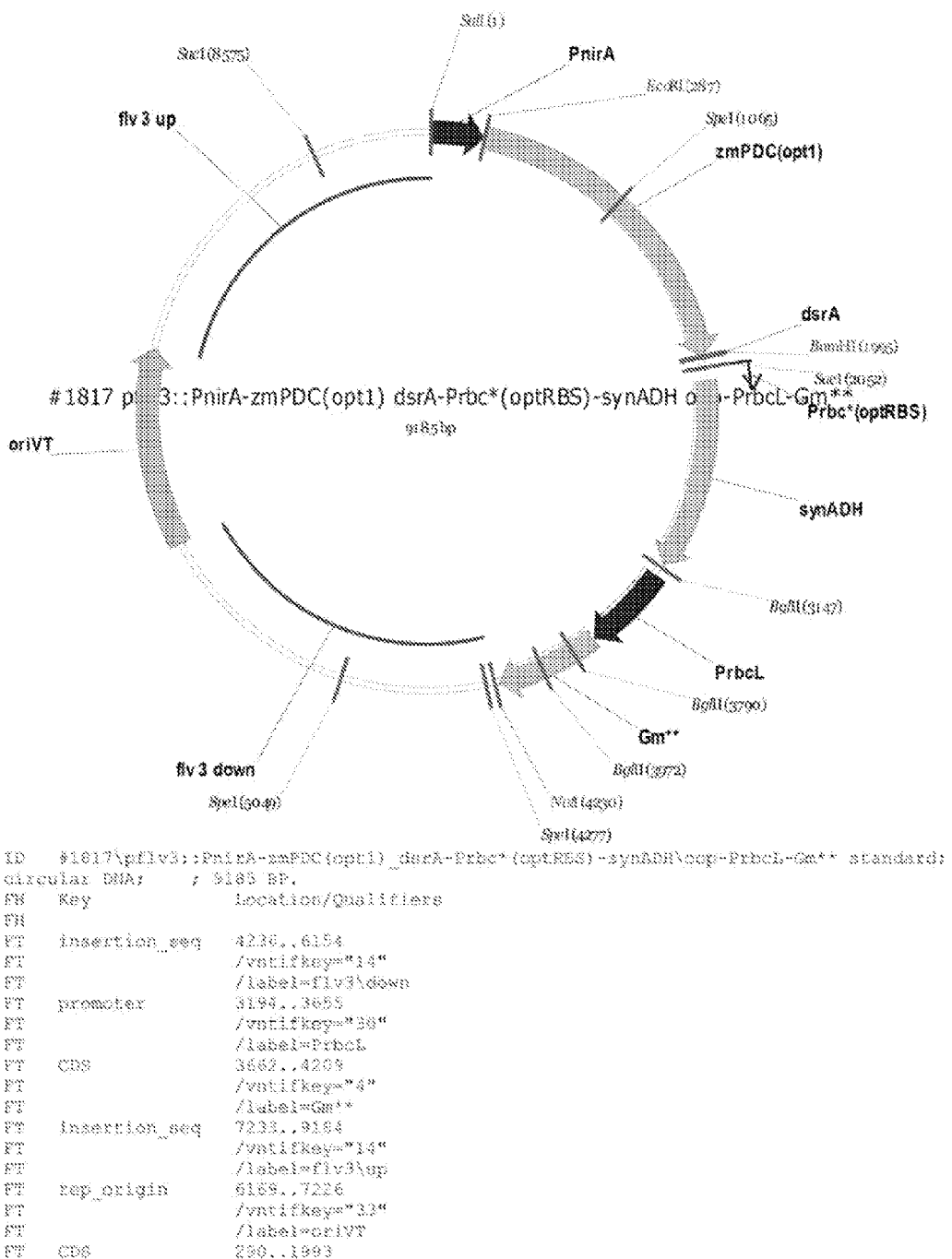

FIG. 157 depicts a plasmid map with sequence annotation of plasmid #1817 (pflv3::PnirA-zmPDC(opt1)_dsrA-Prbc*(optRBS)-synADH\oop-PrbcL-Gm**).

Figure 158:
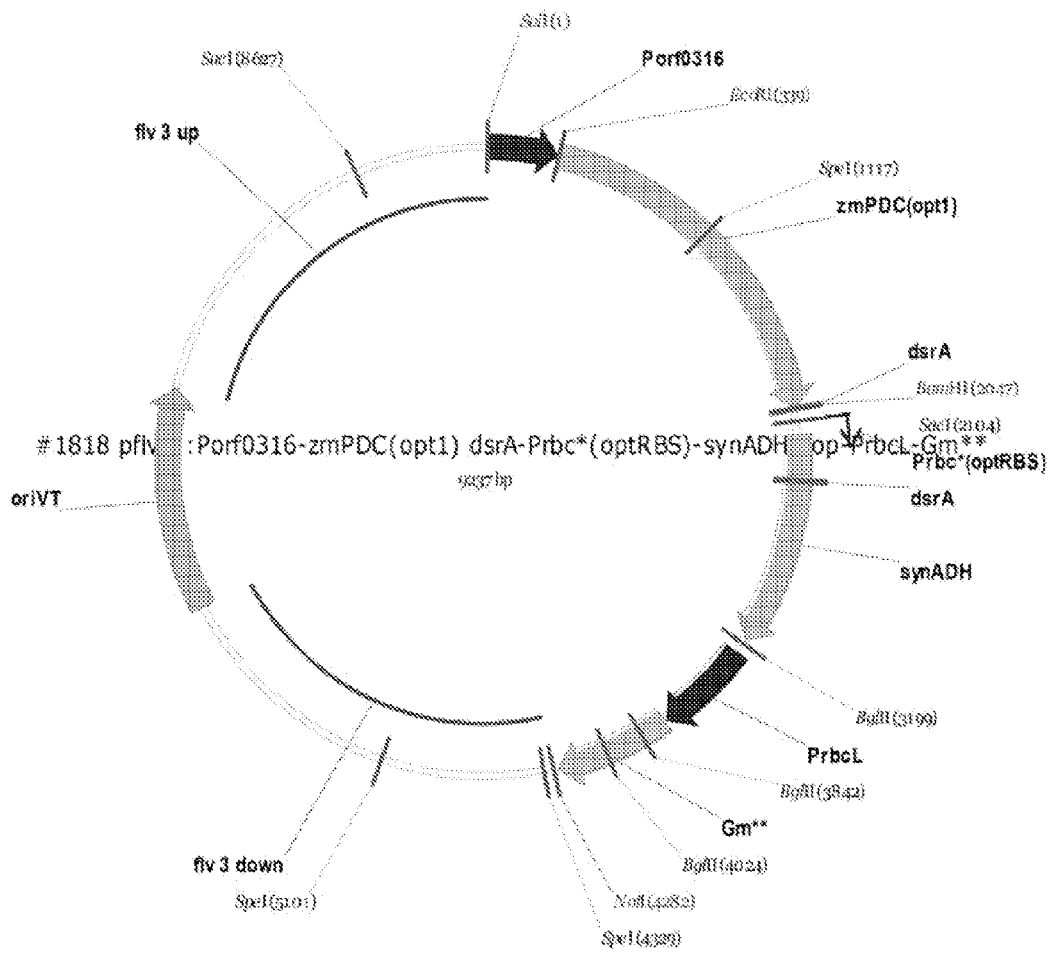

FIG. 158 depicts a plasmid map with sequence annotation of plasmid #1818 (pflv3::Porf0316-zmPDC(opt1)_dsrA-Prbc*(optRBS)-synADH\oop-PrbcL-Gm**).

Figure 159:
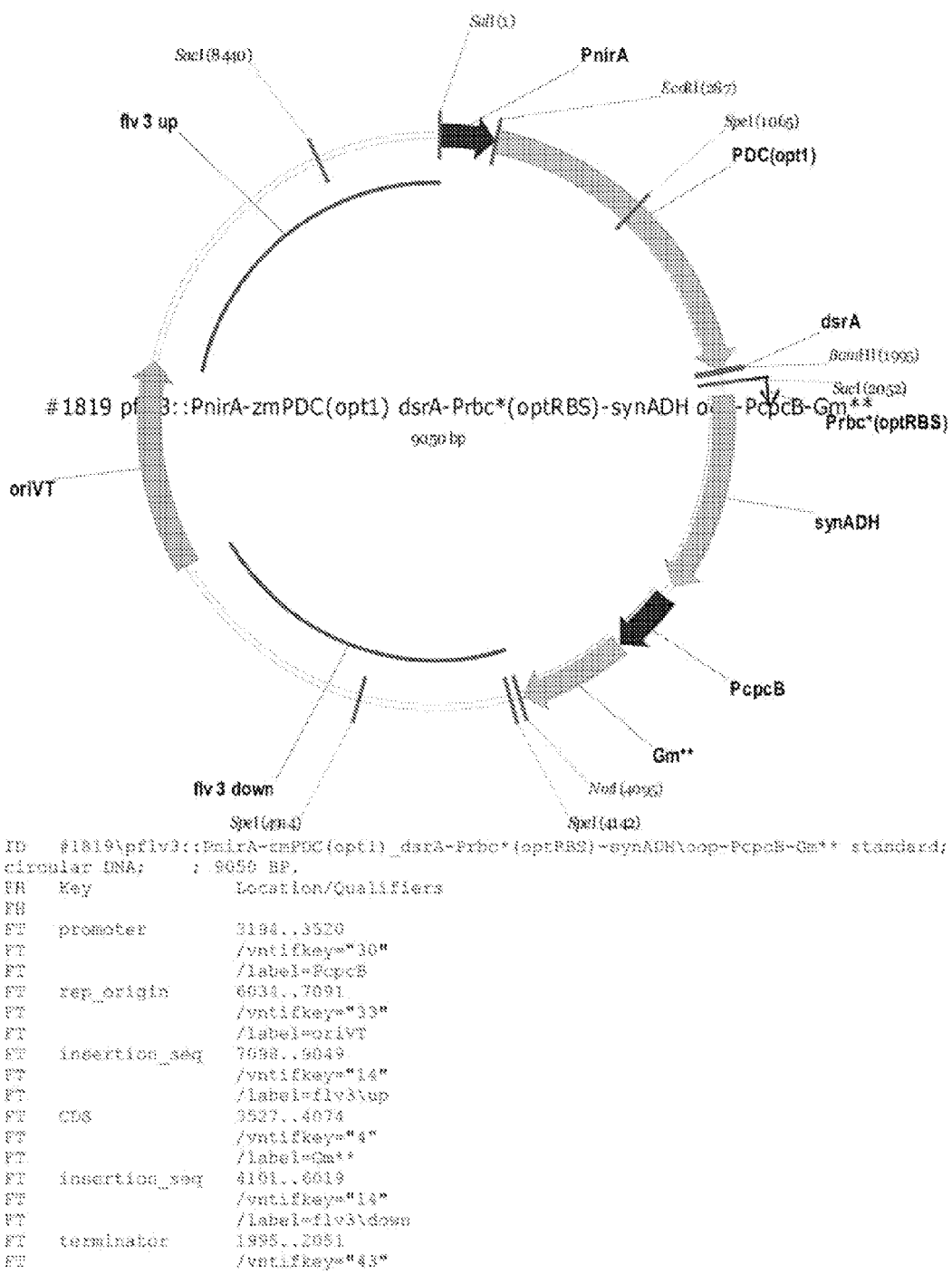

FIG. 159 depicts a plasmid map with sequence annotation of plasmid #1819 (pflv3::PnirA-zmPDC(opt1)_dsrA-Prbc*(optRBS)-synADH\oop-PcpcB-Gm**).

Figure 160:
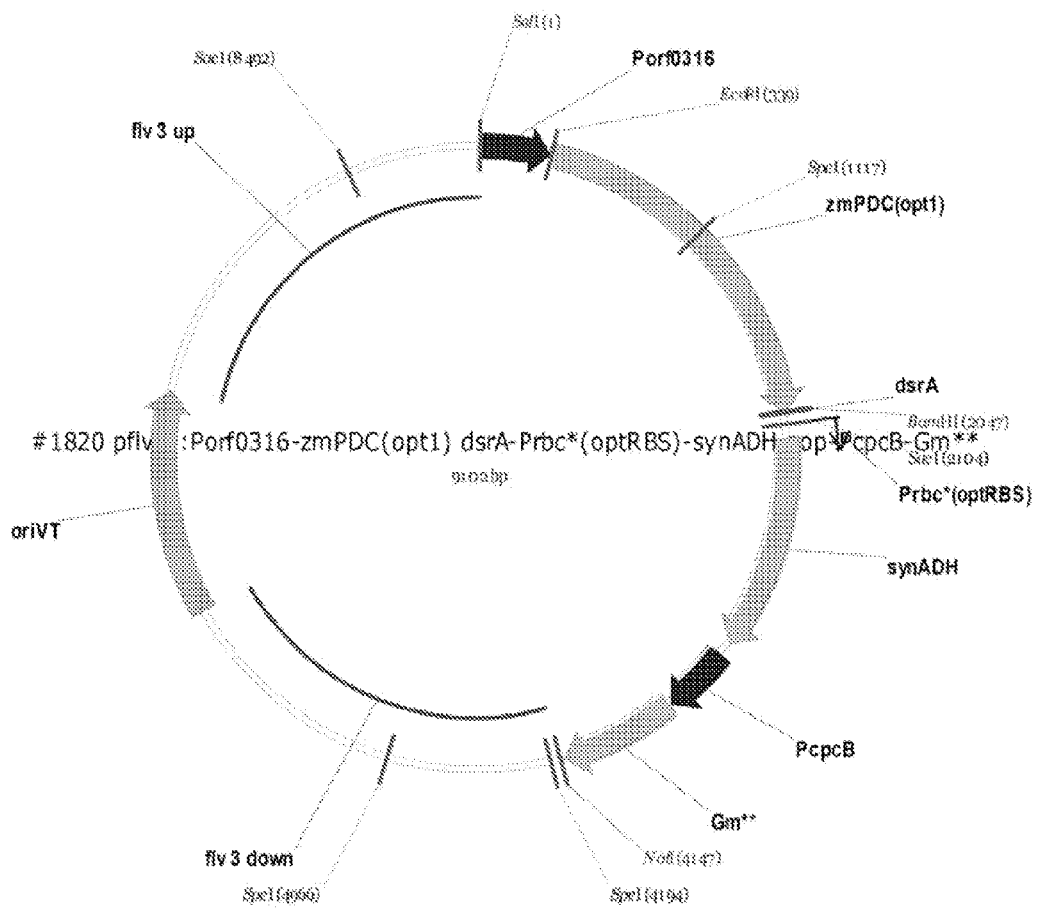

FIG. 160 depicts a plasmid map with sequence annotation of plasmid #1820 (pflv3::Porf0316-zmPDC(opt1)_dsrA-Prbc*(optRBS)-synADH\oop-PcpcB-Gm**).

Figure 161:
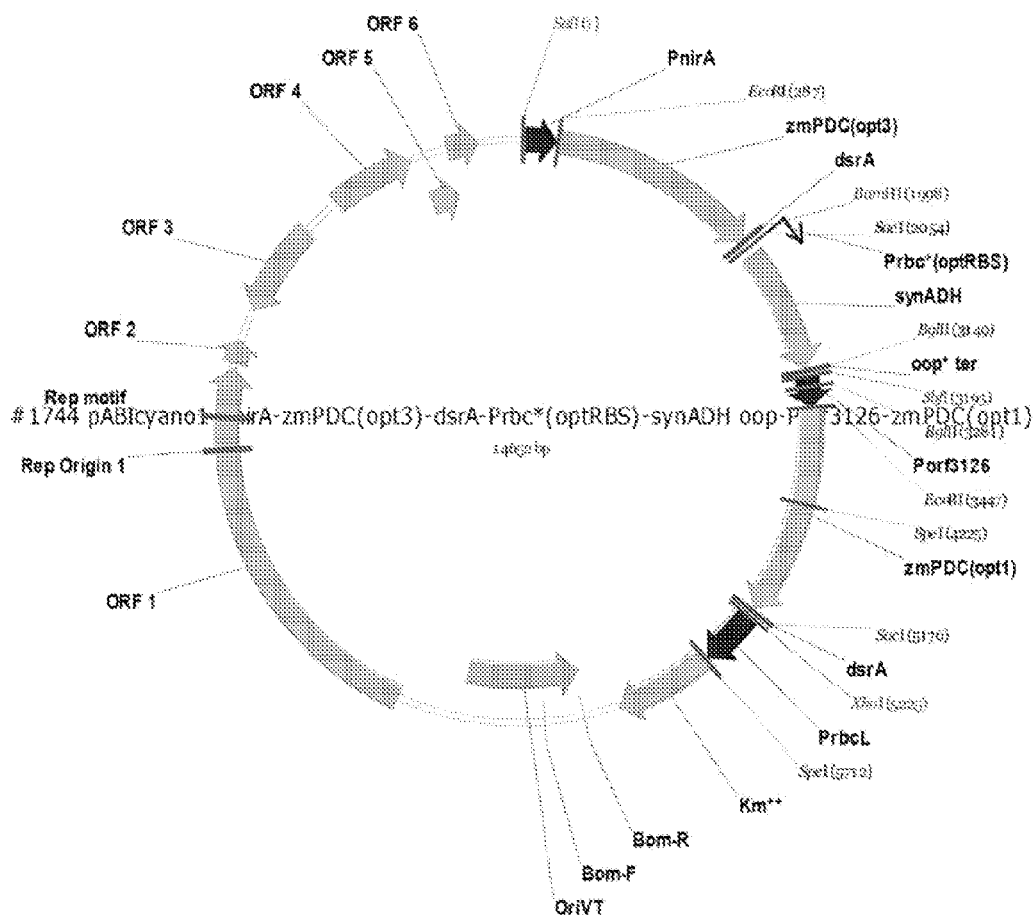

FIG. 161 depicts a plasmid map with sequence annotation of plasmid #1744 (pABIcyano1-PnirA-zmPDC(opt3)-dsrA-Prbc*(optRBS)-synADH\oop-Porf3126-zmPDC(opt1)\dsrA).

Figure 162:
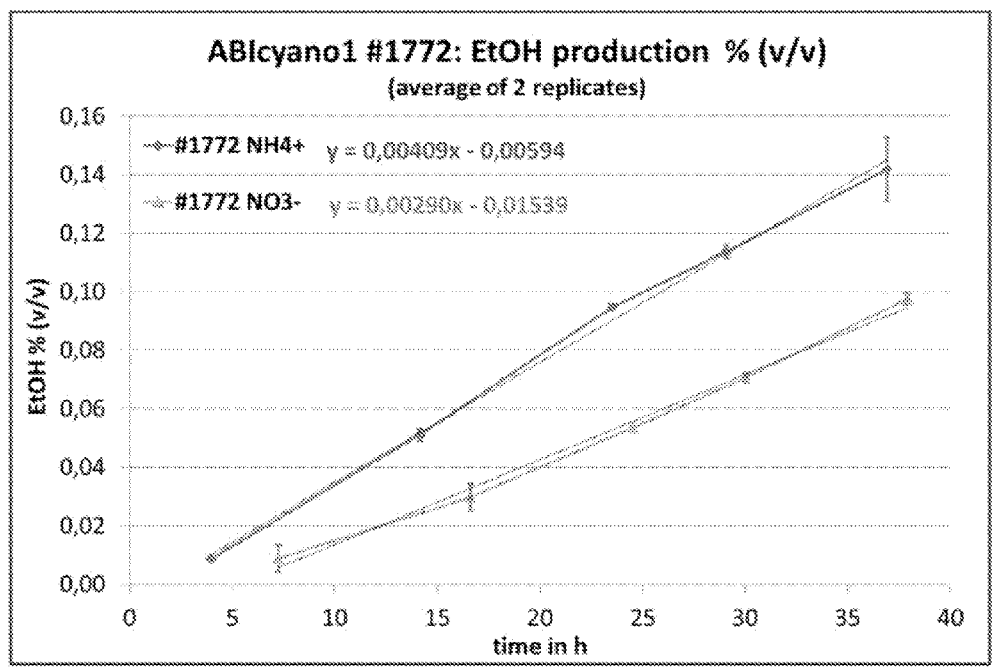

FIG. 162 depicts the ethanologenic acitivity of ABICyano1 comprising #1772 with the endogenous copper-inducible promoter Porf0316 tested with 20×Cu (6 µM $Cu^{2+}$) at a start OD of 2 either grown with ammonia/urea (2 mM each) or nitrate (BG11 recipe) as the sole nitrogen source.

Figure 163:
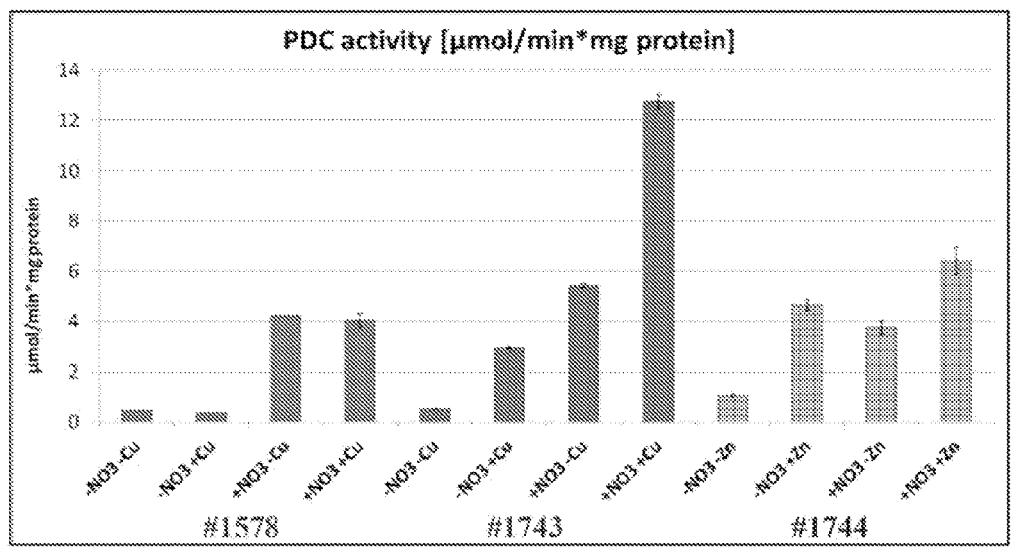

FIG. 163 depicts PDC activity of strains #1578, #1743 and #1744 tested with and without induction by nitrate and copper (#1578 and #1743) and with and without induction by nitrate and zinc (#1744).

Figure 164:
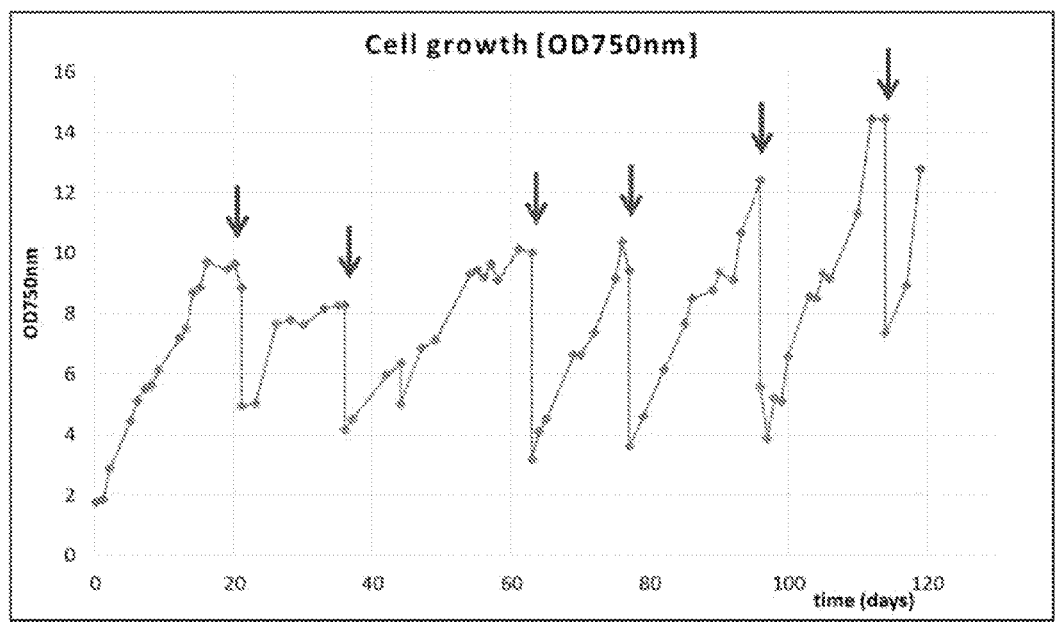

FIG. 164 depicts the growth of TK293 (OD at 750 nm) over about 120 days.

Figure 165:
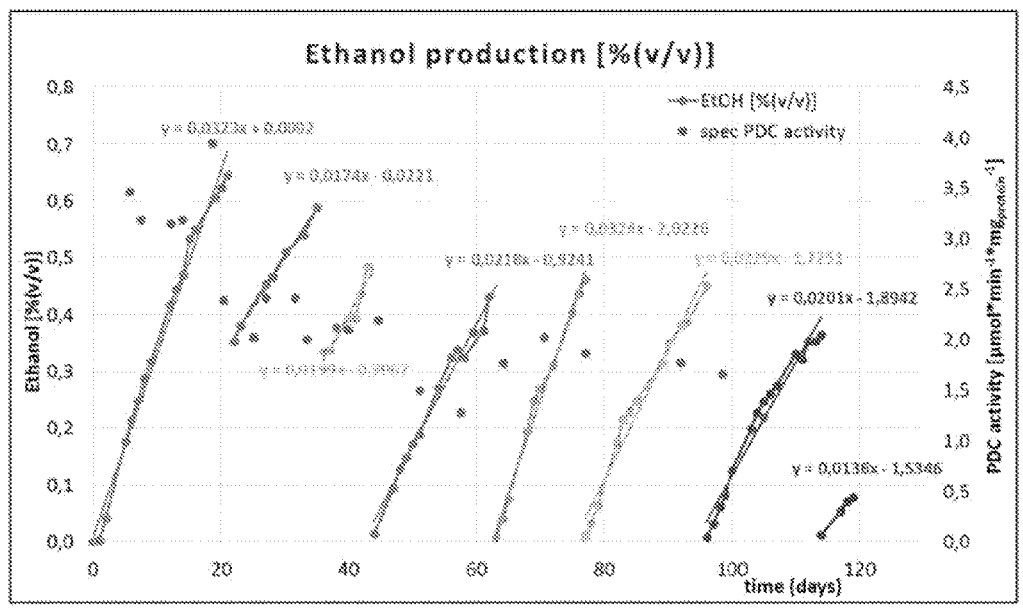

FIG. 165 depicts ethanol production of TK293 and PDC activity of TK293 over about 120 days of cultivation.

DETAILED DESCRIPTION

Disclosed herein is an isolated strain of the *Cyanobacterium* genus, *Cyanobacterium* sp. ABICyano1 (referred to herein as ABICyano1) as well as genetically enhanced, non-naturally occurring ABICyano1 organisms. Genetically enhanced, non-naturally occurring ABICyano1 organisms disclosed herein are useful for the production of compounds of interest, such as ethanol, for example. ABICyano1 has been analyzed by DNA sequencing and is a member of the genus *Cyanobacterium*. *Cyanobacterium* sp. include several species and strains and have been found in a variety of environments including thermal mats in Italy (Moro, et al., 2007, Algological Studies, 123:1-15).

A deposit of *Cyanobacterium* sp. strain ABICyano1 (ABICyano1), disclosed herein and recited in the appended claims, has been made with the American Type Culture Collection (ATCC), 10801 University Boulevard, Manassas, Va. 20110. The date of deposit was Nov. 7, 2012. The ATCC accession number is PTA-13311. The deposited *Cyanobacterium* sp. strain ABICyano1 is not genetically enhanced. The deposit includes 25 2-mL vials, each containing about 1.5 mL of cryopreserved cyanobacterial cells at a concentration of about $2.39 \times 10^7$ cells per mL. To satisfy the enablement requirements of 35 U.S.C. 112, and to certify that the deposit of the present invention meets the criteria set forth in 37 CFR 1.801-1.809, Applicants hereby make the following statements regarding the deposited *Cyanobacterium* sp. strain ABICyano1 (deposited as ATCC Accession No. PTA-13311):

1. During the pendency of this application, access to the invention will be afforded to the Commissioner upon request;

2. Upon granting of the patent the deposit will be available to the public under conditions specified in 37 CFR 1.808;

3. The deposit will be maintained in a public repository for a period of 30 years or 5 years after the last request or for the effective life of the patent, whichever is longer;

4. The viability of the biological material at the time of deposit was tested (see 37 CFR 1.807); and 5. The deposit will be replaced if it should ever become unavailable.

Access to this deposit will be available during the pendency of this application to persons determined by the Commissioner of Patents and Trademarks to be entitled thereto under 37 C.F.R. §1.14 and 35 U.S.C. §122. Upon granting of any claims in this application, all restrictions on the availability to the public of the variety will be irrevocably removed by affording access to a deposit of a sufficient amount of cryopreserved cyanobacterial cells of the same variety with the ATCC.

Definitions

Aspects of the disclosure encompass techniques and methods well known in molecular biology, microbiology and cell culture. Laboratory references for these types of methodologies are readily available to those skilled in the art, see, for example, Molecular Cloning: A Laboratory Manual (Third Edition), Sambrook. J., et al. (2001) Cold Spring Harbor Laboratory Press; Current Protocols in Microbiology (2007) Edited by Coico, R, et al., John Wiley and Sons, Inc.; The Molecular Biology of Cyanobacteria (1994) Donald Bryant (Ed.), Springer Netherlands; Handbook Of Microalgal Culture Biotechnology And Applied Phycology (2003) Richmond, A.; (ed.), Blackwell Publishing; and "The Cyanobacteria, Molecular Biology, Genomics and Evolution", Edited by Antonia Herrero and Enrique Flores, Caister Academic Press, Norfolk, UK, 2008.

It is well known to a person of ordinary skill in the art that large plasmids can be produced using techniques such as the ones described in the US patents U.S. Pat. No. 6,472,184 B1 titled "Method for Producing Nucleic Acid Polymers" and U.S. Pat. No. 5,750,380 titled "DNA Polymerase Mediated Synthesis of Double Stranded Nucleic Acid Molecules", which are hereby incorporated by reference in their entirety.

Genes are disclosed as a three letter lower case name followed by a capitalized letter if more than one related gene exists, for example nirA. The respective protein encoded by that gene is denominated by the same name with the first letter capitalized, such as NirA, or all letters are capitalized.

Promoter sequences, which control the transcription of a gene, are given by a capitalized letter "P" followed by the subscripted gene name according to the above described nomenclature, for example "$P_{nirA}$" for the promoter controlling the transcription of the nirA gene. Promoter sequences may also be referred to without the gene name being subscripted, for example "PnirA".

Enzyme names can be given in a two or three letter code indicating the origin of the enzyme, followed by the above mentioned three letter code for the enzyme itself, such as SynAdh ($Zn^{2+}$ dependent Alcohol dehydrogenase from Synechocystis PCC 6803), ZmPdc (pyurvate decarboxylase from *Zymomonas mobilis*).

All publications and patent applications mentioned in this specification are herein incorporated by reference to the same extent as if each individual publication or patent application was specifically and individually indicated to be incorporated by reference.

Unless defined otherwise, all technical and scientific terms used herein have the meaning commonly understood by a person skilled in the art to which this disclosure belongs. As used herein, the following terms have the meanings ascribed to them unless specified otherwise.

The term "about" is used herein to mean approximately, in the region of, roughly, or around. When the term "about" is used in conjunction with a numerical value/range, it modifies that value/range by extending the boundaries above and below the numerical value(s) set forth. In general, the term "about" is used herein to modify a numerical value(s) above and below the stated value(s) by a variance of 20%.

The term "Cyanobacteria" refers to a member from the group of photoautotrophic prokaryotic microorganisms which can utilize solar energy and fix carbon dioxide. Cyanobacteria are also referred to as blue-green algae.

The term "terminator" refers to a nucleic acid sequence, at which the transcription of a mRNA stops. Non-limiting examples are dsrA from *Escherichia coli*(*E. coli*), the oop terminator or the rho terminator.

The term "*Cyanobacterium* sp." refers to a member of the genus *Cyanobacterium*, as, for example, characterized by Rippka et al., 1983. Ann. Microbiol. (Inst. Pasteur) 134B: 32.

The term "BG-11" or "BG11" refers to a growth media used for growing cyanobacterial species as disclosed in Rippka, R., et al. "Generic Assignments, Strain Histories and Properties of Pure Cultures of Cyanobacteria." (1979) J. Gen. Microbiol. 111: 1-61.

The term "mBG-11" or "mBG11" refers to marine BG11 and in may alternatively be referred to as marine medium. mBG11 has from about 30 to about 38 psu (practical salinity units).

The terms "host cell" and "recombinant host cell" include a cell suitable for metabolic manipulation including, but not limited to, incorporating heterologous polynucleotide sequences and can be transformed. Host cell and recombinant host cell includes progeny of the cell originally transformed. In particular embodiments, the cell is a prokaryotic cell, such as a cyanobacterial cell. The term recombinant host cell is intended to include a cell that has already engineered to have desirable properties and is suitable for further enhancement using the compositions and methods disclosed herein.

The term "shuttle vector" refers to a vector, such as a plasmid, which can propagate in different host species. For example, a shuttle vector with a cyanobacterial origin of replication can be replicated and propagated in different cyanobacterial genera such as *Cyanobacterium*, *Synechococcus*, and *Synechocystis*. Alternatively, or additionally, a shuttle vector may also contain an origin of replication for different phyla of bacteria such as *Enterobacteriaceae* and *Cyanobacteria*, so that cloning/genetic enhancements can performed in *E. coli* and the recombinant plasmid can be expressed/maintained in cyanobacterial hosts. For example, in the latter case, in certain embodiments, the shuttle vector is either a broad host range vector whose origin of replication is recognized by *E. coli* and cyanobacteria, or a plasmid which contains at least two different origins of replication for the appropriate organism.

The term "genome" refers to the chromosomal genome as well as to extrachromosomal plasmids which are normally present in wild type cyanobacteria without having performed recombinant DNA technology.

"Competent to express" refers to a host cell that provides a sufficient cellular environment for expression of endogenous and/or exogenous polynucleotides.

As used herein, the term "genetically enhanced" refers to any change in the endogenous genome (chromosomal and plasmidial) of a wild type cell or to the addition of non-endogenous genetic code to a wild type cell, e.g., the introduction of a heterologous gene. Changes to the genome of various organisms disclosed herein are made by the hand of man through the use of various recombinant polynucleotide technologies and other techniques such as mutagenesis, for example. Included in changes to the genomes are changes in protein coding sequences or non-protein coding sequences, including regulatory sequences such as promoters, enhancers or other regulators of transcription.

The nucleic acids disclosed herein may be modified and/or contain non-natural nucleotide bases.

As used herein, "substantially similar" refers to nucleic acid fragments wherein changes in one or more nucleotide bases results in substitution of one of more amino acids, but do not affect the functional properties of the protein encoded by the DNA sequences. In certain embodiments, changes in one or more nucleotide bases do not change the encoded amino acid. Substantially similar also refers to modifications of the nucleic acid fragments such as substitution, deletion or insertion of one or more nucleotide bases that do not substantially affect the functional properties of the resulting transcript.

As used herein, in certain embodiments, homologous nucleic acid sequences are about 60%, 65%, 68%, 70%, 75%, 80%, 85%, 90%, 91%, 92%, 93%, 94%, 95%, 96%, 97%, 98%, 99%, 99.5%, 99.9%, 99.95% or even higher identical to nucleic acids disclosed herein.

The percentage of identity of two nucleic acid sequences of two amino acid sequences can be determined using the algorithm of Thompson et al. (CLUSTALW, 1994 Nucleic Acid Research 22: 4673-4, 680). A nucleotide sequence or an amino acid sequence can also be used as a so-called "query sequence" to perform a search against public nucleic acid or protein sequence databases in order, for example, to identify further unknown homologous sequences, which can also be used in embodiments of this disclosure. Such searches can be performed using the algorithm of Karlin and Altschul (1999 Proceedings of the National Academy of Sciences U.S.A. 87: 2,264 to 2,268), modified as in Karlin and Altschul (1993 Proceedings of the National Academy of Sciences U.S.A. 90: 5,873 to 5.877). Such an algorithm is incorporated in the NBLAST and XBLAST programs of Altschul et al. (1999 Journal of Molecular Biology 215: 403 to 410). Where gaps exist between two sequences, gapped BLAST can be utilized as described in Altschul et al. (1997 Nucleic Acid Research, 25: 3,389 to 3,402).

"Recombinant" refers to polynucleotides synthesized or otherwise manipulated in vitro or in vivo ("recombinant polynucleotides") and to methods of using recombinant polynucleotides to produce gene products encoded by those polynucleotides in cells or other biological systems. For example, a cloned polynucleotide may be inserted into a suitable expression vector, such as a bacterial plasmid, and the plasmid can be used to transform a suitable host cell. A host cell that comprises the recombinant polynucleotide is referred to as a "recombinant host cell" or a "recombinant bacterium" or a "recombinant cyanobacteria." The gene is then expressed in the recombinant host cell to produce, e.g., a "recombinant protein." A recombinant polynucleotide may serve a non-coding function (e.g., promoter, origin of replication, ribosome-binding site, etc.) as well.

The term "non-naturally occurring", when used in reference to a microbial organism or microorganism herein is intended to mean that the microbial organism has at least one genetic alteration not normally found in a naturally occurring strain of the referenced species, including wild-type strains of the referenced species. Genetic alterations include, for example, modifications introducing expressible nucleic acids encoding metabolic polypeptides, other nucleic acid additions, nucleic acid deletions and/or other functional disruption of the microbial organism's genetic material. Such modifications include, for example, coding regions and functional fragments thereof, for heterologous, homologous or both heterologous and homologous polypeptides for the referenced species. Additional modifications include, for example, non-coding regulatory regions in which the modifications alter expression of a gene or operon such as regions associated with promoters, for example. Exemplary metabolic polypeptides include enzymes or proteins within an ethanologenic biosynthetic pathway resulting in the production of ethanol by a non-naturally occurring organism.

The term "recombinant nucleic acid molecule" includes a nucleic acid molecule (e.g., a DNA molecule) that has been altered, modified or engineered such that it differs in nucleotide sequence from the native or natural nucleic acid molecule from which the recombinant nucleic acid molecule was derived (e.g., by addition, deletion or substitution of one or more nucleotides).

The term "transformation" is used herein to mean the insertion of heterologous genetic material into the host cell. Typically, the genetic material is DNA on a plasmid vector, but other means can also be employed. General transformation methods and selectable markers for bacteria and cyanobacteria are known in the art (Wirth, Mol Gen Genet. 216:175-177 (1989); Koksharova, Appl Microbiol Biotechnol 58:123-137 (2002). Additionally, transformation methods and selectable markers for use in bacteria are well known (see, e.g., Sambrook et al, supra).

The term "homologous recombination" refers to the process of recombination between two nucleic acid molecules based on nucleic acid sequence similarity. The term embraces both reciprocal and nonreciprocal recombination (also referred to as gene conversion). In addition, the recombination can be the result of equivalent or non-equivalent crossover events. Equivalent crossing over occurs between two equivalent sequences or chromosome regions, whereas non-equivalent crossing over occurs between identical (or substantially identical) segments of nonequivalent sequences or chromosome regions. Unequal crossing over typically results in gene duplications and deletions. For a description of the enzymes and mechanisms involved in homologous recombination see Court et al., "Genetic engineering using homologous recombination," Annual Review of Genetics 36:361-388: 2002.

The term "non-homologous or random integration" refers to any process by which DNA is integrated into the genome that does not involve homologous recombination. It appears to be a random process in which incorporation can occur at any of a large number of genomic locations.

The term "vector" as used herein is intended to refer to a nucleic acid molecule (polynucleotides and oligonucleotides) capable of transporting another nucleic acid to which it has been linked. One type of vector is a "plasmid," which generally refers to a circular double stranded DNA molecule into which additional DNA segments may be ligated, but also includes linear double-stranded molecules such as those resulting from amplification by the polymerase chain reaction (PCR) or from treatment of a circular plasmid with a restriction enzyme.

Some vectors are capable of autonomous replication in a host cell into which they are introduced (e.g., vectors having an origin of replication which functions in the host cell). Other vectors can be integrated into the genome of a host cell upon introduction into the host cell, and are thereby replicated along with the host genome. Moreover, certain vectors are capable of directing the expression of genes to which they are operatively linked. Such vectors are referred to herein as "recombinant expression vectors" (or simply "expression vectors").

The term "promoter" is intended to include a polynucleotide segment that can transcriptionally control a gene of interest, e.g., a pyruvate decarboxylase gene that it does or does not transcriptionally control in nature. In one embodiment, the transcriptional control of a promoter results in an increase in expression of the gene of interest. In an embodiment, a promoter is placed 5' to the gene of interest. A heterologous promoter can be used to replace the natural promoter, or can be used in addition to the natural promoter. A promoter can be endogenous with regard to the host cell in which it is used or it can be a heterologous polynucleotide sequence introduced into the host cell, e.g., exogenous with regard to the host cell in which it is used. Promoters may also be inducible, meaning that certain exogenous stimuli (e.g., nutrient starvation, heat shock, mechanical stress, light exposure, etc.) will induce the promoter leading to the transcription of an operably linked gene.

The phrase "operably linked" means that the nucleotide sequence of the nucleic acid molecule or gene of interest is linked to the regulatory sequence(s), e.g., a promoter, in a manner which allows for regulation of expression (e.g., enhanced, increased, constitutive, basal, attenuated, decreased or repressed expression) of the nucleotide sequence and expression of a gene product encoded by the nucleotide sequence (e.g., when the recombinant nucleic acid molecule is included in a recombinant vector, as defined herein, and is introduced into a microorganism).

The term "gene" refers to an assembly of nucleotides that encode for a polypeptide, and includes cDNA and genomic DNA nucleic acids. "Gene" also refers to a nucleic acid fragment that expresses a specific protein or polypeptide, including regulatory sequences preceding (5' non-coding sequences) and following (3' non-coding sequences) the coding sequence.

The term "exogenous" as used herein is intended to mean that the referenced molecule or the referenced activity is introduced into the host microbial organism. The molecule can he introduced, for example, by introduction of an encoding nucleic acid into the host cell genetic material such as by integration into a host chromosome or as non-chromosomal genetic material such as a plasmid. Therefore, the term as it is used in reference to expression of an encoding nucleic acid refers to introduction of the encoding nucleic acid in an expressible form into the microbial organism. When used in reference to a biosynthetic activity, the term refers to an activity that is introduced into the host reference organism. The source can be, for example, a homologous or heterologous encoding nucleic acid that expresses the referenced activity following introduction into the host microbial organism. Therefore, the term "endogenous" refers to a referenced molecule or activity that is present in the host. Similarly, the term when used in reference to expression of an encoding nucleic acid refers to expression of an encoding nucleic acid contained within the microbial organism. The term "heterologous" refers to a molecule or activity derived from a source other than the referenced species whereas "homologous" refers to a molecule or activity derived from the host microbial organism. Accordingly, exogenous expression of an encoding nucleic acid of the invention can utilize either or both a heterologous or homologous encoding nucleic acid.

The term "fragment" refers to a nucleotide sequence of reduced length relative to the reference nucleic acid and comprising, over the common portion, a nucleotide sequence substantially identical to the reference nucleic acid. Such a nucleic acid fragment according to the disclosure may be included in a larger polynucleotide of which it is a constituent. Such fragments comprise, or alternatively consist of, oligonucleotides ranging in length from at least about 6 to about 1500 or more consecutive nucleotides of a polynucleotide according to the disclosure.

The term "open reading frame" abbreviated as "ORF," refers to a length of nucleic acid sequence, either DNA, cDNA or RNA that contains a translation start signal or initiation codon, such as an ATG or AUG, and a termination codon and can be potentially translated into polypeptide sequence.

The term "upstream" refers to a nucleotide sequence that is located 5' to a reference nucleotide sequence. In particular, upstream nucleotide sequences generally relate to sequences that are located on the 5' side of a coding sequence or starting point of transcription. For example, most promoters are located upstream of the start site of transcription.

The term "downstream" refers to a nucleotide sequence that is located 3' to a reference nucleotide sequence. In particular, downstream nucleotide sequences generally relate to sequences that follow the starting point of transcription. For example, the translation initiation codon of a gene is located downstream of the start site of transcription.

The terms "restriction endonuclease" and "restriction enzyme" refer to an enzyme that binds and cuts within a specific nucleotide sequence within double stranded DNA.

The term "expression" as used herein, refers to the transcription and stable accumulation mRNA derived from a nucleic acid or polynucleotide. Expression may also refer to translation of mRNA into a protein or polypeptide. Expression may also be used to refer to the process by which a gene's coded information is converted into the structures and functions of a cell, such as a protein, transfer RNA, or ribosomal RNA.

An "expression cassette" or "construct" refers to a series of polynucleotide elements that permit transcription of a gene in a host cell. Typically, the expression cassette includes a promoter and a heterologous or native polynucleotide sequence that is transcribed. Expression cassettes or constructs may also include, e.g., transcription termination signals, polyadenylation signals, and enhancer elements.

The term "codon bias" refers to the fact that different organisms use different codon frequencies.

The term "codon improvement" refers to the modification of at least some of the codons present in a heterologous gene sequence from a triplet code that is not generally used in the host organism to a triplet code that is more common in the particular host organism. This can result in a higher expression level of the gene of interest. The term "codon improvement" can also be used synonymously with codon optimization.

The term "reporter gene" refers to a nucleic acid encoding an identifying factor that can be identified based upon the reporter gene's effect, in order to determine or confirm that a cell or organism contains the nucleic acid of interest, and/or to measure gene expression induction or transcription.

The term "selectable marker" means an identifying factor, usually an antibiotic or chemical resistance gene, that is able to be selected for based upon the marker gene's effect, such as resistance to an antibiotic, resistance to a herbicide, colorimetric markers, enzymes, fluorescent markers, and the like, wherein the effect is used to track the inheritance of a nucleic acid of interest and/or to identify a cell or organism that has inherited the nucleic acid of interest.

A "heterologous protein" refers to a protein not naturally produced in the cell.

An "isolated polypeptide" or "isolated protein" is a polypeptide or protein that is substantially free of those compounds that are normally associated therewith in its natural state (e.g., other proteins or polypeptides, nucleic acids, carbohydrates, lipids).

An "isolated organism" is an organism that is substantially free of other organisms that are normally associated therewith in its natural state.

The term "tolerate" refers to the ability of an organism to continue to grow after exposure to a condition. In one embodiment, "tolerate" is defined as the ability of an organism to grow after being exposed to an environmental condition after being exposed to the condition for at least 2 hours per day over a time period of at least 7 days. In another embodiment, "tolerate" is synonymous with withstand. In an embodiment ability of an organism to tolerate environmental conditions is refereed to as "hardiness".

A "variant" of a polypeptide or protein is any analogue, fragment, derivative, or mutant which is derived from a polypeptide or protein and which retains at least one biological property of the polypeptide or protein. Different variants of the polypeptide or protein may exist in nature. These variants may be allelic variations characterized by differences in the nucleotide sequences of the structural gene coding for the protein, or may involve differential splicing or post-translational modification. The skilled artisan can produce variants having single or multiple amino acid substitutions, deletions, additions, or replacements.

As used herein, the term "VLE" stands for vapor-liquid equilibrium. VLE is a method of determining ethanol concentration in a medium by measuring the ethanol concentration in a vapor over the medium. VLE relies upon the vapor pressure of ethanol in a medium and other variables such as temperature and exchange of other gasses in the vapor. In one embodiment, ethanol concentration of the vapor phase over the medium is measured by gas chromatagraphy. In another embodiment, Raman spectroscopy, infrared spectroscopy and other spectrographic analyses may be performed in order to determine the concentration of a compound of interest in the vapor phase over a medium.

As used herein, the phrase "increased activity" refers to any genetic modification resulting in increased levels of enzyme function in a host cell. As known to one of ordinary skill in the art, in certain embodiments, enzyme activity may be increased by increasing the level of transcription, either by modifying promoter function or by increasing gene copy number, increasing translational efficiency of an enzyme messenger RNA, e.g., by modifying ribosomal binding, or by increasing the stability of an enzyme, which increases the half-life of the protein, leading to the presence of more enzyme molecules in the cell. All of these represent non-limiting examples of increasing the activity of an enzyme, see for example, mRNA Processing and Metabolism: Methods and Protocols, Edited by Daniel R. Schoenberg, Humana Press Inc., Totowa, N.J.; 2004; ISBN 1-59259-750-5; Prokaryotic Gene Expression (1999) Baumberg, S., Oxford University Press, ISBN 0199636036; The Biomedical Engineering Handbook (2000) Bronzino, J. D., Springer, ISBN 354066808X, all of which are incorporated by reference.

The terms "pyruvate decarboxylase", "Pdc" and "PDC" refer to an enzyme that catalyzes the decarboxylation of pyruvic acid to acetaldehyde and carbon dioxide. A "pdc gene" refers to the gene encoding an enzyme that catalyzes the decarboxylation of pyruvic acid to acetaldehyde and carbon dioxide.

The terms "alcohol dehydrogenase", "Adh" and "ADH" refer to an enzyme that catalyzes the interconversion between alcohols and aldehydes or ketones. An "adh gene" refers to the gene encoding an enzyme that catalyzes the interconversion between alcohols and aldehydes or ketones.

The term "pdc/adh" refers to the pdc and adh genes collectively. A "pdc/adh cassette" refers to a nucleic acid sequence encoding a PDC enzyme and an ADH enzyme.

The term "ethanologenic cassette" refers to any polynucleotide sequence that encodes for enzymes capable of producing ethanol alone or in combination with other exogenous or endogenous enzymes. In a certain embodiment, an ethanologenic cassette comprises genes encoding for an alcohol dehydrogenase and a pyruvate decarboxylase. In another embodiment, an ethanologenic cassette comprises genes encoding for a bifunctional alcohol/aldehyde dehydrogenase. In certain embodiments, an ethanologenic cassette comprises genes encoding for enzymes that are part of a biochemical pathway to generate precursors for alcohol dehydrogenases and pyruvate decarboxylases of an ethanologenic cassette.

The term "primer" is an oligonucleotide that hybridizes to a target nucleic acid sequence to create a double stranded nucleic acid region that can serve as an initiation point for DNA synthesis under suitable conditions. Such primers may be used in a polymerase chain reaction.

The term "polymerase chain reaction," also termed "PCR," refers to an in vitro method for enzymatically amplifying specific nucleic acid sequences. PCR involves a repetitive series of temperature cycles with each cycle comprising three stages: denaturation of the template nucleic acid to separate the strands of the target molecule, annealing a single stranded PCR oligonucleotide primer to the template nucleic acid, and extension of the annealed primer(s) by DNA polymerase. PCR provides a means to detect the presence of the target molecule and, under quantitative or semi-quantitative conditions, to determine the relative amount of that target molecule within the starting pool of nucleic acids.

Database entry numbers as used herein may be from the NCBI database (National Center for Biotechnology Information) or from the CyanoBase, the genome database for cyanobacteria; Yazukazu et al. "CyanoBase, the genome database for Synechocystis sp. Strain PCC6803: status for the year 2000", Nucleic Acid Research, 2000, Vol. 18, page 72).

The enzyme commission numbers (EC numbers) cited throughout this patent application are numbers which are a numerical classification scheme for enzymes based on the chemical reactions which are catalyzed by the enzymes.

Growth of ABICyano1 in Adverse Environmental Conditions

In comparison to other cyanobacterial species, ABICyano1 grows quickly and can tolerate and grow over a large range of various environmental stresses related to temperature, salinity, light intensity, oxygen levels, pH and the presence of contaminants including chemical and microbial contaminants. ABICyano1's ability to tolerate wide-ranging environmental parameters makes it ideally suited to growth in cyanobacterial culture systems. ABICyano1 can be genetically enhanced to express endogenous and exogenous genes used for the production of compounds of interest, such as biofuels, and still tolerates and grows over a large range of various environmental stresses related to temperature, salinity, light intensity, oxygen levels, pH and the presence of various contaminants.

Methods for cultivation of cyanobacteria in liquid media and on agarose-containing plates are well known to those skilled in the art (see, e.g., websites associated with ATCC). Any of these methods or media maybe used to culture ABICyano1 or derivatives thereof A number of known recipes for cyanobacterial growth medium can be used. In an embodiment, BG11 medium is used for growing ABICyano1, see Stanier, R. Y., et al., Bacteriol. Rev. 1971, 35: 171-205, which is hereby incoiporated by reference.

In an embodiment, the cyanobacterial strain is a fresh water strain, and BG11 is used. In another embodiment, the cyanobacteria culture grows best in a marine (salt water) medium, by adding an amount of salt to the BG11 medium. In an embodiment, marine BG11 (mBG11) contains about 35 practical salinity units (psu), see Unesco, The Practical Salinity Scale 1978 and the International Equation of State of Seawater 1980. Tech. Pap. Mar. Sci., 1981, 36: 25 which is hereby incorporated by reference.

In an embodiment, the cells are grown autotrophically, and the only carbon source is $CO_2$. In another embodiment, the cells are grown mixotrophically, for example with the addition of another carbon source such as glycerol.

The cultures can be grown indoors or outdoors. The light cycle can be set as for continuous light, or for periodic exposure to light, e.g., 16 hours on and 8 hours off, or 14 hours on and 10 hours off, or 12 hours on and 2 hours off, or any alternative variation of on and off hours of light comprising about a day.

The cultures can be axenic, or the cultures can also contain other contaminating species.

In an embodiment, the cyanobacteria are growl in enclosed bioreactors in quantities of at least about 1 L, 20 L, 50 L, 100 L, 500 L, 1000 L, 2000 L, 5000 L, or more. In a preferred embodiment the bioreactors are about 20 L to about 100 L. In an embodiment, the cyanobacterial cell cultures are grown in disposable, flexible, and tubular photobioreactors made of a clear plastic material.

In another embodiment, cultures are grown indoors or outdoors with continuous light, in a sterile environment. In another embodiment, the cultures are grown outdoors in an open pond type of photobioreactor.

Figure 1:
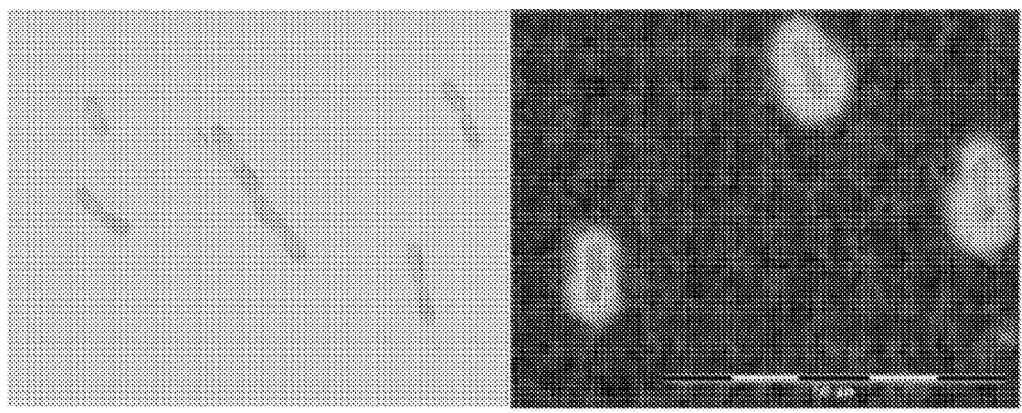
FIG. 1 depicts two panels of microscopic images that demonstrate the presence of the extracellular polymer (EPS) layer that is present in a sheath surrounding the *Cyanobacterium* sp. ABICyano1 cell. The left panel is without stain and the right panel is with a stain specific for EPS.

ABICyano1 cells are generally coccoid in appearance. ABICyano1 cells are sheathed with copious amounts of mucilaginous extracellular material (extracellular polymeric substances, also referred to as exopolysaccharides (referred to herein generally as EPS)), as shown in FIG. 1. This material may help the cells survive in adverse environmental conditions. This mucilage can participate in the formation of cellular aggregates or "clumps". FIG. 1 depicts a panel of microscopic images that demonstrate the presence of the EPS layer that is present in a sheath surrounding the *Cyanobacterium* sp. ABICyano1 cell wherein the bar depicted in the figure is equal to 50 μm. The left panel depicts unstained ABICyano1 cells. The right panel depicts ABICyano1 cells that are stained with scribtol black which cannot penetrate the EPS layer and thus depicts the thick EPS layer of ABICyano1.

Figure 2A:
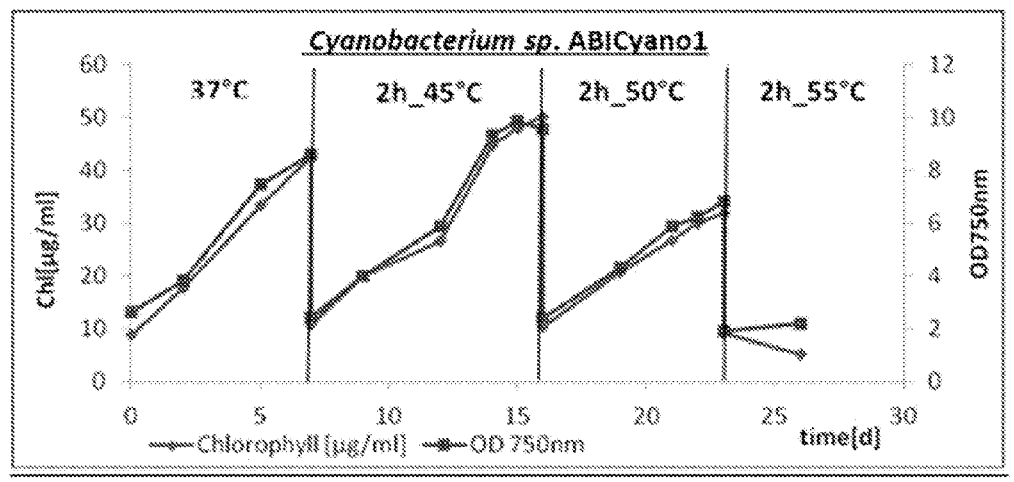
FIGS. 2A and 2B depict the thermotoloerance growth characteristics of *Cyanobacterium* sp. ABICyano1 (panel A) and *Synechococcus* PCC 7002 (panel B).
Figure 2B:
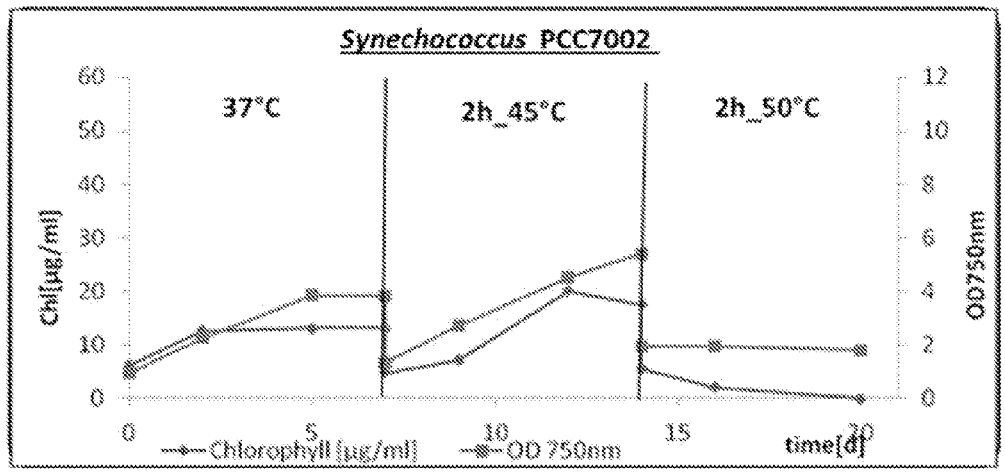

ABICyano1 grows over a broad range of temperatures. In a particular embodiment, ABICyano1 can grow from about 1° C. to about 55° C., from about 5° C. to about 55° C., from about 10° C. to about 55° C., from about 15° C. to about 55° C., from about 20° C. to about 55° C., from about 25° C. to about 55° C., from about 30° C. to about 55° C., from about 35° C. to about 55° C., from about 40° C. to about 55° C., from about 45° C. to about 55° C., or from about 50° C. to about 55° C. In an embodiment, as depicted in FIG. 2A ABICyano1 can grow up to about 55° C., e.g. at temperatures greater than 45° C. or greater than 50° C. including 48° C., 50° C., 53° C., and 55° C. The broad temperature range at which ABICyano1 can grow is larger than many other cyanobacteria. For example, as depicted in FIG. 2B, *Synechococcus* sp. PCC 7002 exhibits growth only up to 45° C. whereas ABICyano1 (FIG. 2A) exhibits robust growth at 50° C. As depicted in FIG. 2, to the test for temperature tolerance, ABICyano1 and *Synechococcus* sp. PCC 7002 were cultured in a medium, e.g. a marine medium, under conditions of light illumination and omitting light illumination (day/night cycle) at maximum temperatures between 45 to 55° C. for a certain period of time, for example 1 to 2 hours, during illumination. Cyanobacterial cells were deemed to have passed the test, if the cultures were still growing after having been subjected to 7 days of day/night cycles as described above. Growth could be detected, for example, by an increase in the chlorophyll content of the cyanobacterial cultures. *Cyanobacterium* sp. ABICyano1 was found to withstand cultivation at 48° C., 50° C. and 53 to 55° C. for at least 2 hours per day over a time period of at least 7 days. As depicted in FIG. 2A, *Cyanobacterium* sp. ABICyano1 grows well even when daytime temperatures get up to about 45° C. to 50° C. for about 2 hours. Growth was measured by chlorophyll content (diamonds; μg/mL) and absorbance at $OD_{750}$ (squares).

In another embodiment, ABICyano1 growth was determined at 45° C., 48° C., 50° C., 53° C., and 55° C. for 1 week and compared to the growth of *Synechocystis* sp. PCC 6803 and *Synechococcus* sp. PCC 7002 under the same conditions. Table 1 depicts that ABICyano1 is capable of growth even after being exposed daily to 53° C. and 55° C. for two hours over the course of a week.

TABLE 1

| | Thermotolerance Test | | | | |
| --- | --- | --- | --- | --- | --- |
| Genus, species | 2 hours at 45° C. for 1 week | 2 hours at 48° C. for 1 week | 2 hours 50° C. for 1 week | 2 hours at 53° C. for 1 week | 2 hours at 55° C. for 1 week |
| *Synechocystis* sp. PCC 6803 | pos. | pos. | neg. | | |
| *Synechococcus* sp. PCC 7002 | pos. | pos. | pos. | neg. | |
| *Cyanobacterium* sp. ABICyano1 | pos. | pos. | pos. | pos. | pos. |

ABICyano1 was further tested for its ability to tolerate and grow in various environmental conditions. Some of the conditions tested would likely be present in large-scale culture systems, such as photobioreactors in outdoor conditions, for growing cyanobacteria including ranges of temperatures, oxygen levels, light levels, pH levels, and the presence of contaminants. ABICyano1 grows in various media containing various concentrations of salts. In a particular embodiment, ABICyano1 can grow in fresh water media containing salts at less than about 0.5 parts per thousand, brackish water containing salts at from about 0.5 parts per thousand to about 30 parts per thousand, and saline water containing salts from about 30 parts per thousand to about 50 parts per thousand. In some embodiments, ABICyano1 is grown in media including freshwater BG11 and marine (saline) BG11 (mBG11) medium, which can, for example, have a salinity of between about 30 to 38 psu (practical salinity units also measured as water containing salts at 30 to 38 parts per thousand), in particular 35 psu.

In an embodiment, ABICyano1 can grow in media containing from about zero percent ethanol up to at least 1% ethanol. ABICyano1 was shown to survive exposure to at least 1% (v/v) ethanol in a BG11 medium, for example. This culturing was done for at least 6 weeks, at least 12 weeks, or at least 16 weeks. In a particular embodiment, ABICyano1 cells were grown at 250 μmolE $m^{-2}sec^{-1}$, a 12 hours of light and 12 hours with no light cycle, at 37° C. with ethanol supplemented in the growth media. The test for ethanol tolerance was performed by adding 1% ethanol to the growth medium of ABI- Cyano1. Cyanobacterial cultures were examined, for example under the microscope after a predetermined period of time, for example 6, 12 or 16 weeks and cyanobacterial cultures were deemed to have passed the ethanol tolerance test if at least or more than 50% of the cyanobacterial cells were found to be intact, i.e. viable according to microscopic analysis weaning that the cell morphology id not change significantly, the cells were still green, and the cells were not lysed.

In an embodiment, ABICyano1 can grow in the absence of oxygen all the way up to media containing oxygen concentrations of about 1000 µmol/L or more. Oxygen tolerance testing showed that ABICyano1, can tolerate purging with 60% to 80% (v/v) oxygen (resulting in oxygen levels of up to 1000 µmol/L the culture during the day) when cultured at temperatures between 28° C. to 37° C. and when being illuminated with a light intensity of between 200 $\mu E\ m^{-2}s^{-1}$ to 400 $\mu E\ m^{-2}s^{-1}$ in a medium such as marine BG11 or, in some embodiments, BG11 medium. In another embodiment, ABICyano1 can tolerate oxygen levels of about 100 µmol/L, 200 µmol/L, 300 µmol/L, 400 µmol/L, 500 µmol/L, 600 µmol/L, 700 µmol/L, 800 µmol/L, and about 900 µmol/L in the growth medium.

ABICyano1 was also shown to tolerate a wide range of pH values and can be cultured at neutral or a slightly alkaline pH of 7.5, a pH between 6 to 7.5, and at a pH between 5.5 to 10, about 6, about 7, about 8, about 9, or about 10.

ABICyano1 cultures are resistant to the growth of contaminating microbial organisms. For example, contaminating strains in ABICyano1 cultures do not grow to as high density as compared to contaminant strains in other cultures of known cyanobacterial strains. As an example of the resistance of growth of microbial organisms in an ABICyano1 culture, about $10^5$-$10^6$ cfu/mL of contaminating strains were found in ABICyano1 cultures and about $10^9$-$10^{15}$ cfu/mL of contaminating strains were found in *Synechococcus* sp. PCC 7002 cultures.

In an embodiment, ABICyano1 host cells, can withstand at least one of the following culturing conditions: 1% (v/v) ethanol in the medium for at least 6, 12 or 16 weeks; 48° C., 50° C., 53 to 55° C. for at least 2 hours per day over a time period of at least 7 days, and purging with 60% to 80% (v/v) oxygen (resulting in oxygen concentrations of up to 1000 µmol/L in the culture during the day). In an embodiment, the *Cyanobacterium* sp., in particular ABICyano1 host cells, can tolerate at least two of the above mentioned culturing conditions. In an embodiment, the *Cyanobacterium* sp., in particular ABICyano1 host cells, can tolerate all of the above mentioned culturing conditions.

The tolerance (also referred to as hardiness) to a wide range of growth temperatures, and tolerance to environmental conditions in general, make *Cyanobacterium* sp. ABICyano1 amenable to industrial scale production of compounds of interest in potentially adverse environmental conditions such as those found in photobioreactors.

ABICyano1 Endogenous Plasmids

ABICyano1 contains two endogenous plasmids. In combination with other genotypic and phenotypic attributes, these two endogenous plasmids differentiate ABICyano1 from other *Cyanobacterium* species.

Figure 3:
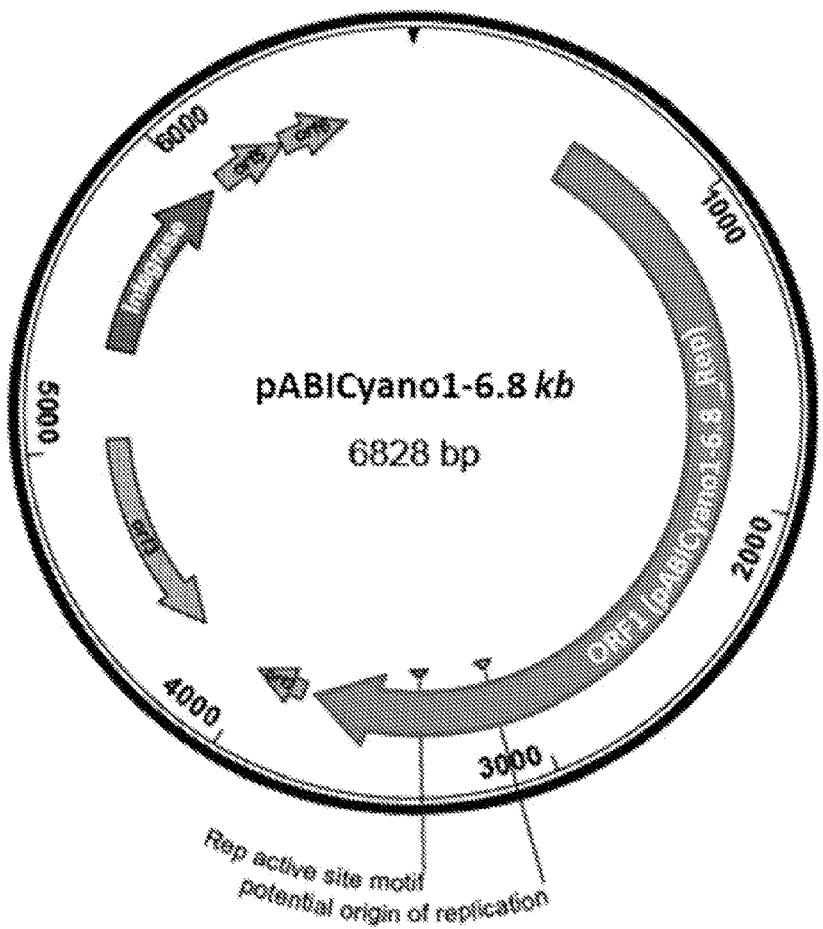
FIG. 3 depicts a plasmid map with sequence annotation of the 6828 bp endogenous plasmid of *Cyanobacterium* ABICyano1 cell.

One plasmid is 6828 base pairs (SEQ ID NO: 1) and the other plasmid is 35,386 base pairs (SEQ ID NO: 2). The 6828 bp endogenous plasmid (SEQ ID NO: 1) is alternatively referred to herein as pABICyano1, p6.8 or 6.8. A plasmid map of the 6828 endogenous plasmid is depicted in FIG. 3

The p6.8 endogenous plasmid was isolated by an in vitro transposition reaction with an EZ-Tn5 R6KγOri/Kan-2 transposition kit from Epicentre (Madison Wis., USA) by following the manufacturer's protocol. The cyanobacterial plasmid was rescued in surrogate *E. coli* host cells. The sequence and site of the captured plasmid was confirmed and validated by PCR, as well as by comparison with available genome sequence data.

ABICyano1 endogenous plasmid p6.8 contains six open reading frames ORF 1, ORF 2, ORF 3, ORF 4, ORF 5, and ORF 6 encoding for polypeptides having sequences as set forth in SEQ ID NO: 3, SEQ ID NO: 4, SEQ ID NO: 5, SEQ ID NO: 6, SEQ ID NO: 7, and SEQ ID NO: 8, respectively. With respect to the nucleotide sequence of SEQ ID NO: 1 of p6.8, ORF 1 consists of nucleotides 594 to 3779, ORF 2 consists of nucleotides 3815 to 4000, ORF 3 consists of nucleotides 4260 to 5024, ORF 4 consists of nucleotides 5350 to 6036, ORF 5 consists of nucleotides 6078 to 6341, ORF 6 consists of nucleotides 6338 to 6586, and the origin of replication consists of nucleotides 3375 to 3408.

As disclosed herein, plasmid 6.8 has been modified in vivo and in vitro for use as a plasmid vector containing genes of interest for the production of compounds of interest.

In an embodiment, a modified endogenous vector derived from p6.8 from ABICyano1 was developed. The modified endogenous vector from ABICyano1 can be used to transform cyanobacteria from a broad range of genera, including ABICyano1 itself.

In certain embodiments, the present invention includes the p6.8 plasmid and modified vectors comprising sequences of the p6.8 plasmid. In an embodiment, the modified endogenous vector contains at least one of the following: a recombinant gene that encodes at least one protein involved in a biosynthetic pathway for the production of a compound or a marker protein; and an origin of replication suitable for replication in ABICyano1.

In certain embodiments, a gene coding for a replication initiation factor that binds to the origin of replication can either be present on the modified endogenous vector or can be present in the chromosomes or other extrachromosomal plasmids of ABICyano1. An origin of replication suitable for replication in ABICyano1 and the gene coding for the replication initiation factor binding to that origin of replication ensure that the modified endogenous vector can be replicated in ABICyano1.

In an embodiment, the nucleotide sequence of an origin of replication of the modified endogenous plasmid vector can have at least 80%, 90%, and 95% identity or can be identical to the nucleotides 3375 to 3408 of the sequence of the endogenous 6.8 kb plasmid (SEQ ID NO: 1).

In an embodiment, the sequence of the gene coding for the replication initiation factor has at least 80%, 90%, and 95% identity or is identical to nucleotides 594 to 3779 of the sequence of the endogenous 6.8 kb plasmid (SEQ ID NO: 1). In an embodiment, the gene coding for the replication initiation factor codes for a protein having at least 80%, 90%, and 95% sequence. identity or is identical to the protein coded by nucleotides 594 to 3779 of the sequence of the endogenous 6.8 kb plasmid (SEQ ID NO: 1) of ABICyano1. This putative initiation replication factor is thought to bind to the putative origin of replication, thereby ensuring the replication of a plasmid containing the initiation factor in ABICyano1.

In an embodiment, a modified endogenous plasmid vector can contain a sequence having at least 50%, at least 55%, at least 60%, at least 65%, at least 70%, at least 75%, at least 80%, at least 85%, at least 90% or at least 95% identity to the sequence of the endogenous 6.8 kb plasmid (SEQ ID NO: 1). In another embodiment, the modified endogenous vector contains the entire p6.8 endogenous plasmid from ABICyano1.

In another embodiment, gene delivery vehicles that are developed using the endogenous 6.8 kb plasmid (or a portion of the plasmid) containing characteristic portions of the endogenous 6.8 kb plasmid may be able to be efficiently transformed into a wide range of cyanobacteria. In an embodiment, characteristic portions of the 6.8 kb endogenous plasmid from ABICyano1 include portions that enable it to replicate in a host cell (origin of replication and replication initiation factor, for example) and can be referred to as the backbone of the endogenous 6.8 kb plasmid. Such vectors may also be able to efficiently produce heterologous proteins and other compounds of interest in cyanobacterial cultures.

In another embodiment, modifications starting with the backbone of the 6.8 kb endogenous plasmid from ABICyano1 are performed individually or together to increase transformation efficiency, increase the replication rate within the cell, and to increase the production of a desired product from the cyanobacterial cell. Suitable modifications include, for example, insertion of selection markers (such as antibiotic resistance genes), recombinant genes or cassettes for the production of a desired compound, and other modifications to increase the expression or stability of the plasmid in the cyanobacterial cell. In an embodiment, the invention includes cyanobacteria, e.g. ABICyano1, comprising a modified p6.8 plasmid having any of these improved characteristics.

In yet another embodiment, codon improvement of the at least one recombinant gene is performed for improved expression in the cyanobacterial host cell. Codon improvement can also be performed by adapting the codon usage of the at least one recombinant gene to the codon usage in *Cyanobacterium* in particular ABICyano1. In an embodiment, the G and/or C wobble bases in the codons for the amino acids in the at least one recombinant gene can be replaced by A and/or T because the GC content of the genome of ABICyano1 is relatively low at about 36%.

In an embodiment, only 2% to 6% or 1% to 10% of the codons of variants of recombinant genes are codon improved. In another embodiment, highly codon improved variants of recombinant genes, at least 25%, to at least 50%, 65% or even at least 70% of the codons have been changed. In another embodiment, recombinant genes are used which are not codon improved.

Phylogenetic Classification of ABICyano1

Figure 4:
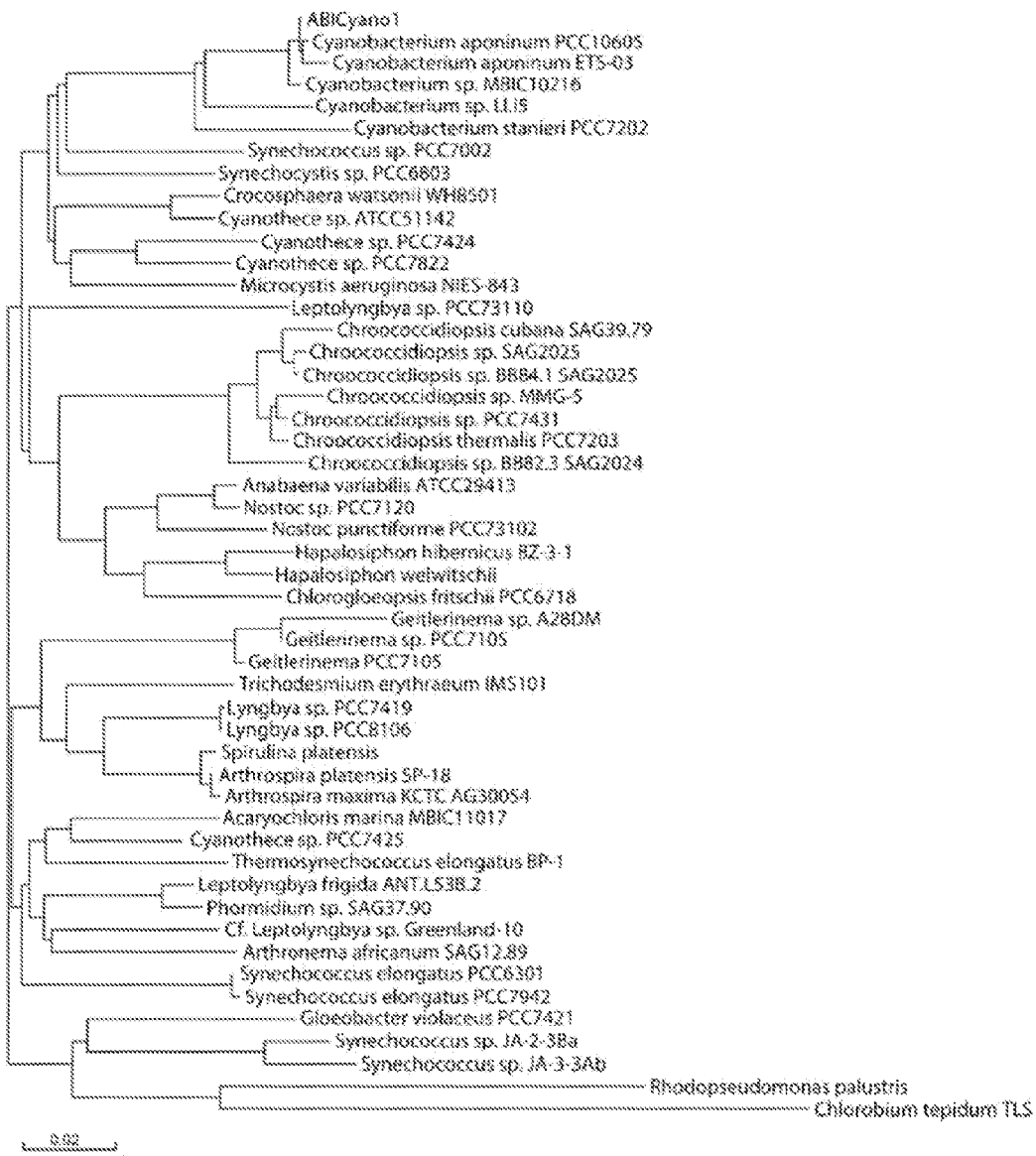
FIG. 4 depicts a phylogenetic tree showing the relationship between *Cyanobacterium* sp. ABICyano1 and other cyanobacterial genera and species.

FIG. 4 depicts a phylogenetic tree showing the relationship between ABICyano1 and other cyanobacterial genera and species. As depicted in FIG. 4, ABICyano1 is a member of the *Cyanobacterium* genus. The tree was built with the 16S rRNA gene sequences with the Neighbor-Joining method using the Tamura-Nei nucleotide substitution model assuming uniform heterogeneity among sites. The scale bar indicates the number of substitutions per site.

ABICyano1 differs in many ways from other species in the *Cyanobacterium* genus, as well as from other cyanobacterial genera such as *Synechococcus* and *Synechocystis*. Differences include, but are not limited to, endogenous plasmids, carotenoid and chlorophyll composition, and differences in its 16S rDNA and internal transcribed spacer rDNA (ITS), for example.

Figure 5:
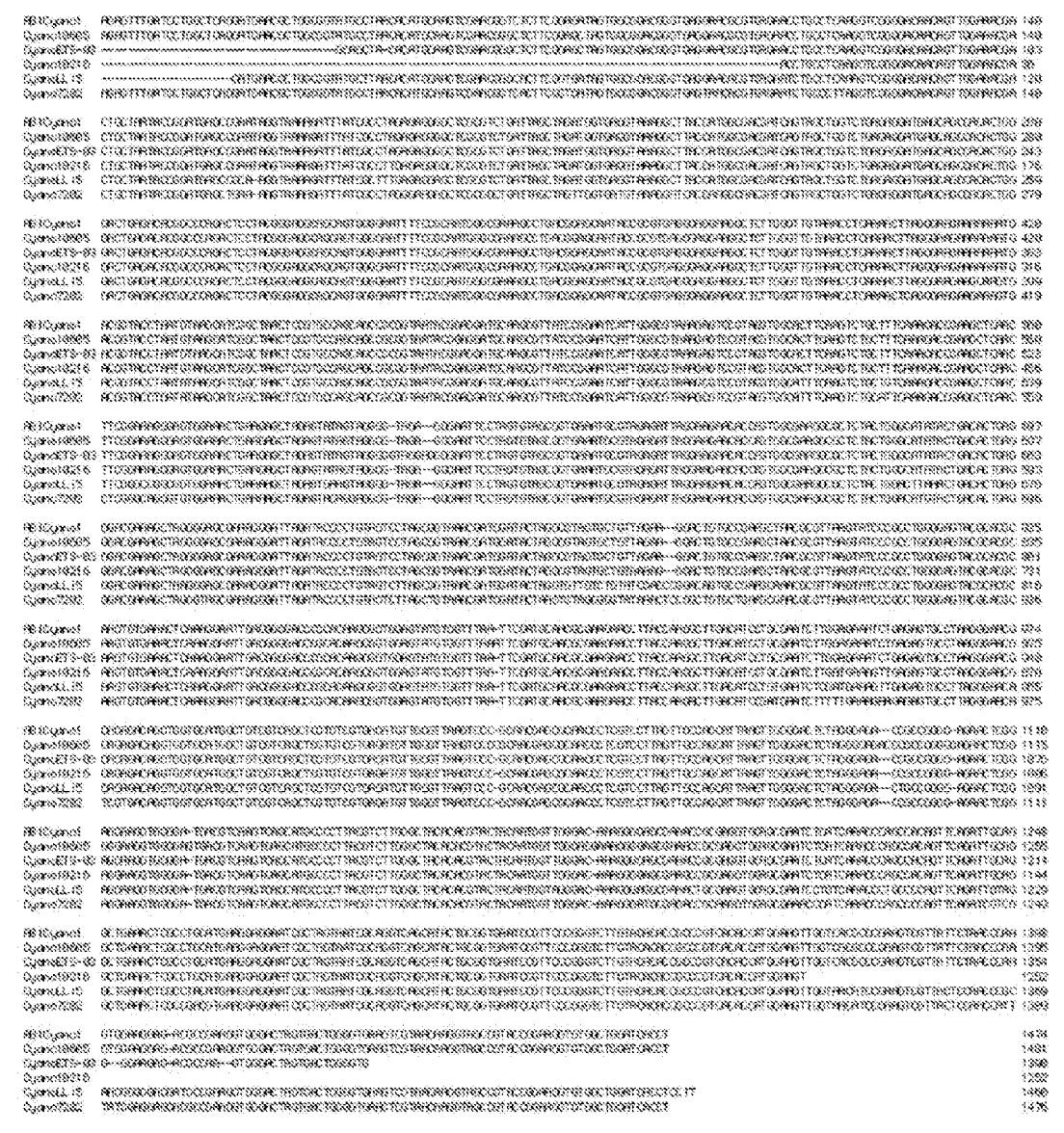

FIG. 5 depicts a sequence comparison of the 16S rDNA of ABICyano1 with 16S rDNA from other *Cyanobacterium* species. The 16S rRNA gene sequences (16S rDNA) of ABICyano1 were predicted from the genome sequence with RNAmmer program (Lagesen K, et al. (2007) *Nucleic Acids Research* 35(9):3100-3108). The predicted sequences were then used as a query to search against the NCBI database. 16S rDNA sequences from four species belonging to the genus *Cyanobacterium* were retrieved as the top BLAST hits. Cyano10216 is the 16S rDNA sequence of *Cyanobacterium* sp. MBIC10216, accession number AB058249.1. CyanoETS-03 is the 16S rDNA sequence of *Cyanobacterium aponinum* ETS-03, accession number AM238427.1. CyanoLLi5 is the 16S rDNA sequence of *Cyanobacterium* sp. LLi5, accession number DQ786164.1. Cyano7202 is the 16S rDNA sequence for *Cyanobacterium stanieri* PCC 7202, accession number AM258981.1. According to this one comparative phylogenetic characteristic, and as depicted in FIG. 5, ABICyano1 is about 99% identical to the 16S rDNA of other species from the genus *Cyanobacterium* including *Cyanobacterium* IHB-410, *Cyanobacterium aponinum* ETS-03, and *Cyanobacterium* sp. MBIC10216.

Transformation of ABICyano1

Some strains of cyanobacteria can be transformed through natural uptake of exogenous DNA. Other cyanobacterial strains can be transformed, for example, by the use of conjugation or electroporation. Some cyanobacterial strains are difficult to transform by any known means. For many of these types of difficult to transform strains, specific methods of preparing the cells for transformation, as well as specific methods of allowing entry of the foreign DNA into the cells, need to be designed de novo.

ABICyano1 is very difficult to transform. The mucilaginous sheath may play a role in the transformation difficulties, as may the presence of restriction enzyme systems. Nevertheless, disclosed herein are compositions and methods for transforming ABICyano1 with endogenous and exogenous DNA.

Methods for producing a genetically enhanced, non-naturally occuring *Cyanobacterium* sp. and ABICyano1 host cells are disclosed herein. In an embodiment, methods include introducing a recombinant nucleic acid sequence into a cyanobacterial host cell. At least one recombinant gene can be introduced into the host cells through the transformation of the host cell by an extrachromosomal plasmid. In an embodiment, the extrachromosomal plasmid can independently replicate in the host cell. In another embodiment, at least one recombinant gene can be introduced into the genome of the host cell. In yet another embodiment, at least one recombinant gene is introduced into the genome of the host cell by homologous recombination.

In an embodiment, a recombinant nucleic acid sequence can be provided as part of an extrachromosomal plasmid containing cyanobacterial nucleic acid sequences in order to increase the likelihood of success for the transformation.

In another embodiment, the method for producing a genetically enhanced *Cyanobacterium* sp. host cell uses an extrachromosomal plasmid derived from an endogenous plasmid of the host cell to introduce a recombinant nucleic acid sequence into the host cell. This endogenous plasmid can be, for example, an extrachromosomal plasmid derived from the 6.8 kb endogenous plasmid of ABICyano1.

In yet another embodiment, the method for producing a genetically enhanced *Cyanobacterium* sp. host cell involves protecting the recombinant nucleic acid sequence, for example a plasmid, against endogenous restriction endonucleases of the host cell by methylating at least a part of the recombinant nucleic acid sequence or modifying and/or eliminating the recognition sequences of the endogenous restriction endonucleases. By changing the nucleic acid sequence of potential recognition sites of restriction endonucleases, a digest of the recombinant nucleic acid sequence can be avoided. It was discovered that endogenous restriction endonucleases of ABICyano1 can cut an extrachromosomal plasmid carrying recombinant genes, thereby preventing a genetic transformation event of this host cell.

In an embodiment, methyltransferases, for example AvaI and AcyI, can be used to protect recombinant vector extrachromosomal plasmids. The plasmids can either be incubated with the methyltransferases in vitro or a helper plasmid can be present in a helper *E. coli* strain in order to methylate the extrachromosomal plasmids in vivo before conjugation takes place during the transformation of ABICyano1. In another embodiment, recognition sequences for the restriction enzymes can be modified or deleted. As described by Elhai and Wolk, in Conjugal Transfer of DNA to Cyanobacteria in Methods in Enzymology 02/1988; 167:747-54, herein incorporated by reference, plasmid pRL528 can be used as a helper plasmid for conjugal transfer. The indicated genes are M. AvaI coding for the methyltransferase protecting against the restriction endonuclease AvaI and the respective gene coding for M. AvaII. The latter is not required for transformation of ABICyano1, as it lacks any endonuclease activity of AvaII.

In an embodiment, the vector to be transformed into *Cyanobacterium* sp. host cells can be modified to integrate into the cyanobacterial chromosome by adding an appropriate DNA sequence homologous to the target region of the host genome. In another embodiment, the vector to be transformed can be modified to integrate into the cyanobacterial chromosome through in vivo transposition by introducing mosaic ends to the vector. Once the plasmid is established in the host cell, it can be present, for example, at a range of from 1 to many copies per cell.

In an embodiment, an endogenous plasmid derived from ABICyano1 can be modified, either in vivo or in vitro, to be a plasmid vector capable of introducing exogenous genes encoding enzymes for the production of a compound or compounds of interest into a wide range of host cyanobacterial cells such as ABICyano1, *Cyanobacterium* sp., or other cyanobacterial genera such as *Synechocystis* and *Synechococcus*.

The transfer of exogenous genes into cyanobacteria often involves the construction of vectors having a backbone from a broad-host range bacterial plasmid, such as RSF1010. The RSF1010-based vector has been widely used as a conjugation vector for transforming bacteria, including cyanobacteria (Mermet-Bouvier et al. (1993) "Transfer and Replication of RSF1010-derived Plasmids in Several Cyanobacteria of the Genera *Synechocystis* and *Synechococcus*" Current Microbiology 27:323-327). RSF1010 has an *E. coli* origin of replication, but does not have a cyanobacterial origin of replication.

As an example of additional tools used to transfer exogenous genes into cyanobacteria, several endogenous plasmids from *Synechococcus* sp. PCC 7002 were used as the backbone portions for plasmids to prepare vectors for heterologous gene expression, see Xu et al., Photosynthesis Research Protocols 684:273-293 (2011). Other vectors for transformation of cyanobacteria include the pDUI-based vectors. The pDUI origin of replication is best suited for filamentous cyanobacteria. Attempts to transform ABICyano1, with either RSF1010 or pDUI-based shuttle vectors were unsuccessful using the techniques as described in the art.

In an embodiment, the ABICyano1 6.8 kb endogenous plasmid is used as a backbone for a plasmid vector used for transformation of *Cyanobacterium* sp. Since this is the endogenous vector from the species, it is likely to be more stable when transformed into the cell than plasmids derived from completely different organisms. In an embodiment, the entire p6.8 endogenous plasmid is inserted into a vector used for transformation. In another embodiment, a sequence of about 50%, 70%, 75%, 80% 85%, 90%, 95%, 98%, 99%, or 99.5% identity to the entire endogenous plasmid sequence is inserted into the extrachromosomal plasmid vector.

In an embodiment, a modified p6.8 vector is designed to have several modular units that can be swapped out using specific restriction enzymes. Promoters, genes of interest, selectable markers, and other desired sequences can be moved in and out of the vector as desired. This modular design makes genetic experiments faster and more efficient.

The modified p6.8 vector, according to certain embodiments of the disclosure, can replicate in both cyanobacteria and in *E. coli*. The vector contains a replication unit that can function in a broad range of cyanobacterial genera. The vector also contains a replicon for propagation in *E. coli* for ease of cloning and genetic manipulation using *E. coli*.

In an embodiment, a plasmid shuttle vector is provided which is characterized by being replicable in both *E. coli* and cyanobacterial species. The plasmid comprises a promoter capable of functioning in cyanobacteria and *E. coli* and a DNA sequence encoding a sequence capable of functioning as a selective marker for both *E. coli* and cyanobacteria. In another embodiment, the shuttle vector includes two different promoter systems, one functioning in cyanobacteria and the other one functional in *E. coli*. In an embodiment, the plasmid shuttle vector contains at least 50% of the p6.8 plasmid. The plasmid shuttle vector enables the efficient transformation of cyanobacteria and the expression of recombinant genes of interest.

In another embodiment, the p6.8 derived plasmid vector also contains an origin of transfer (oriT) which is suitable for conjugation. In particular, the plasmid vector can contain a combined origin of replication and an origin of transfer (oriVT), which enables replication in *Enterobacteriaceae*, in particular *E. coli*, and which also enables conjugation with, for example, an *E. coli* donor strain and *Cyanobacterium* sp., in particular ABICyano1 as a recipient strain. Such an plasmid vector can be used for triparental mating wherein a conjugative plasmid present in one bacterial strain assists the transfer of a mobilizable plasmid, for example a plasmid vector disclosed herein, present in a second bacterial strain into a third recipient bacterial strain, which can be ABICyano1.

Also disclosed herein is a non-naturally occurring p6.8 derived vector in which a gene of interest, the recombinant gene, is operably linked to a shuttle vector. In an embodiment, cyanobacterial cells are transformed with the recombinant shuttle vector. The recombinant shuttle vector is relatively small in size, relatively stable in a cyanobacterial host cell, and can replicate in a variety of cyanobacterial species. This recombinant vector is useful for expressing a variety of heterologous genes in cyanobacteria.

In an embodiment for transforming host cells with p6.8 derived vectors, a shuttle vector expresses a codon-optimized antibiotic resistance gene ($Ab^R$), such as codon improved kanamycin or gentamycin resistance genes. In an embodiment, the shuttle vector is constructed based on a modular basis so that all of the key elements (replication ori, $Ab^R$ gene and reporter gene) are exchangeable via unique restriction sites thus providing versatile cloning options and facilitating the delivery of genes of interest to target organisms. Other antibiotic resistance genes can be used if desired. For example, genes conferring resistance to ampicillin, chloramphenicol, spectinomycin or other antibiotics can be inserted into the vector, under the control of a suitable promoter. In some embodiments, the vector contains more than one antibiotic resistance gene.

In yet another embodiment, the p6.8 derived vector is modified by several factors so that it is capable of efficient replication in multiple types of cyanobacterial species. The vector has also been organized so that various sequences can be easily replaced with other desired sequences as needed. Thus, a construct having a different gene (or genes) of interest, a different antibiotic, a different promoter, etc. can be made with relative ease. The modified vector allows for rapid testing of various heterologous constructs in a cyanobacterial cell.

Any suitable promoter can be used to regulate the expression of the genes present in the vector. Exemplary promoter types include, for example, constitutive promoters, inducible promoters, endogenous promoters, heterologous promoters, and the like.

In an embodiment, the modular design of the p6.8 derived vector allows complex sequence manipulation in cyanobacteria.

In an embodiment, cyanobacteria disclosed herein can be transformed to add biochemical pathways to produce compounds of interest. Recombinant DNA sequences encoding genes can be amplified by PCR using specific primers. The amplified PCR fragments can then be digested with the appropriate restriction enzymes and cloned into either a self-replicating plasmid or into an integrative plasmid. An antibiotic resistance cassette for selection of positive clones can be present on the appropriate plasmid.

In an embodiment, the recombinant nucleic acids of interest can be amplified from nucleic acid samples using known amplification techniques. PCR can be used to amplify the sequences of the genes directly from mRNA, from cDNA, from genomic libraries or cDNA libraries. PCR and other in vitro amplification methods may also be useful, for example, to clone nucleic acid sequences that code for proteins to be expressed, to make nucleic acids to use as probes for detecting the presence of the desired mRNA in samples, and for nucleic acid sequencing.

In an embodiment, recombinant DNA vectors suitable for transformation of cyanobacteria can be prepared. For example, a DNA sequence encoding one or more of the genes described herein can be combined with transcriptional and other regulatory sequences which will direct the transcription of the sequence from the gene in the transformed cyanobacteria.

In an embodiment, recombinant genes of interest are inserted into the cyanobacterial chromosome. When the cell is polyploid, the gene insertions can be present in all of the copies of the chromosome, or in some of the copies of the chromosome.

In another embodiment, recombinant genes are present on an extrachromosomal plasmid. The extrachromosomal plasmid can be derived from an outside source such as RSF10-based plasmid vectors, for example, or can be derived from an endogenous plasmid from *Cyanobacterium* sp. host cells or from other cyanobacteria.

In an embodiment, recombinant genes are present on an extrachromosomal plasmid having multiple copies per cell. The plasmid can be present, for example, at about 1, 3, 5, 8, 10, 15, 20, 30, 40, 50, 60, 70, 80, 90, or more copies per cyanobacterial host cell. In an embodiment, the recombinant plasmids are fully segregated from the non-recombinant plasmids.

In another embodiment, recombinant genes are present on one cassette driven by one promoter. In another embodiment, the recombinant genes are present on separate plasmids, or on different cassettes.

In yet another embodiment, recombinant genes are modified for optimal expression by modifying the nucleic acid sequence to accommodate the cyanobacterial cell's protein translation system. Modifying the nucleic acid sequences in this maimer can result in an increased expression of the genes.

Methods of genetic engineering of plasmids using *E. coli* are generally known in the art. In some embodiments disclosed herein, the plasmid construct preparation is performed in *E. coli* to allow for ease of genetic manipulation. In order to be propagated in *E. coli*, an origin of replication suitable for *Enterobacteriaceae*, in particular *E. coli*, is incorporated into the plasmid vector. Once the construct is prepared and changed in *E. coli*, the plasmid can then be transferred to the cyanobacterial cell, where it can replicate as an independent plasmid. Alternatively, the plasmid vector can also be synthesized via solid phase synthesis so that an origin of replication for *Enterobacteriaceae* does not need to be present in the plasmid vector.

Exemplary methods suitable for transformation of cyanobacteria include, as non-limiting examples, natural DNA uptake (Chung, et al. (1998) FEMS Microbiol. Lett. 164: 353-361; Frigaard, et al. (2004) Methods Mol. Biol. 274: 325-40; Zang, et al. (2007) J. Microbiol. 45: 241- 245), conjugation, transduction, glass bead transformation (Kindle, et al. (1989) J. Cell Biol. 109: 2589-601; Feng, et al. (2009) Mol. Biol. Rep. 36: 1433-9; U.S. Pat. No. 5,661,017), silicon carbide whisker transformation (Dunahay, et al. (1997) Methods Mol. Biol. (1997) 62: 503-9), biolistics (Dawson, et al. (1997) Curr. Microbiol. 35: 356-62; Hallmann, et al. (1997) Proc. Natl. Acad. USA 94: 7469-7474; Jakobiak, et al. (2004) Protist 155:381-93; Tan, et al. (2005) J. Microbiol. 43: 361-365; Steinbrenner, et al. (2006) Appl Environ. Microbiol. 72: 7477-7484; Kroth (2007) Methods Mol. Biol. 390: 257-267; U.S. Pat. No. 5,661,017) electroporation (Kjaerulff, et al. (1994) Photosynth. Res. 41: 277-283; Iwai, et al. (2004) Plant Cell Physiol. 45: 171-5: Ravindran, et al. (2006) J. Microbiol. Methods 66: 174-6; Sun, et al. (2006) Gene 377: 140-149; Wang, et al. (2007) Appl. Microbiol. Biotechnol. 76: 651-657; Chaurasia, et al. (2008) J. Microbiol. Methods 73: 133-141; Ludwig, et al. (2008) Appl. Microbiol. Biotechnol. 78: 729- 35), laser-mediated transformation, or incubation with DNA in the presence of or after pretreatment with any of poly(amidoamine) dendrimers (Pasupathy, et al. (2008) Biotechnol. J. 3: 1078-82), polyethylene glycol (Ohnuma, et al. (2008) Plant Cell Physiol. 49: 117-120), cationic lipids (Muradawa, et al. (2008) J. Biosci. Bioeng. 105: 77-80), dextran, calcium phosphate, or calcium chloride (Mendez-Alvarez, et al. (1994) J. Bacteriol. 176: 7395-7397), optionally after treatment of the cells with cell wall-degrading enzymes (Perrone. et al. (1998) Mol. Biol. Cell 9: 3351-3365). Biolistic methods (see, for example, Ramesh, et al. (2004) Methods Mol. Biol. 274: 355-307; Doestch, et al. (2001) Curr. Genet. 39: 49-60; all of which are incorporated herein by reference in their entireties.

Extracellular Polymer Layer of ABICyano1

In an embodiment, a method of producing a genetically enhanced *Cyanobacterium* sp. host cell including non-naturally occurring ABICyano1 organisms, involves the steps of subjecting the host cell to compounds that increase the permeability of the extracellular polymer layer (also referred to as exopolysaccharide layer or EPS) and cell wall of the host cell and introducing an exogenous polynucleic acid into the host cell.

In an embodiment, in order to introduce the at least one recombinant gene into an ABICyano1 host cell, the permeability of the EPS is increased beforehand so that the recombinant nucleic acid sequence can pass through the EPS layer and reach the interior of the cyanobacterial cell.

In an embodiment, compounds that increase the permeability of the EPS and cell wall of the *Cyanobacterium* sp. host cell include N-acetyleysteine (NAC), lysozyme, β-galactosidase and combinations thereof. In an embodiment, a combination of NAC and lysozyme is used.

In an embodiment, the *Cyanobacterium* sp. host cell is first subjected to NAC followed by a treatment of lysozyme and then transformed. The inventors found out that such a pretreatment drastically increased the number of transformants in contrast to transformation attempts lacking pretreatment.

In one embodiment, the present invention includes cyanobacteria having an EPS layer, wherein the organism has been treated such that it has a 5-fold, 10-fold, 50-fold and about 100-fold increased rate of transformation as compared to the corresponding untreated cyanobacteria. In an embodiment, the ABICyano1 host cell can be subjected to NAC for 0.5 to 3 days. In another embodiment, the host cell is subjected to NAC for 1 to 2 days. In an embodiment, after subjecting the host cell to NAC, the host cell is further treated with lysozyme for 3 min. to 1 hour. In an embodiment, after subjecting the host cell to NAC, the host cell is further treated with lysozyme for 10 to 30 min. In an embodiment, after subjecting the host cell to NAC, the host cell is further treated with lysozyme for 10 to 15 min.

In an embodiment, NAC treatment is carried out at a temperature of 12 to 37° C. In an embodiment, NAC treatment is carried out at a temperature of 16° C. In an embodiment, lysozyme treatment is conducted in a temperature range from 20° C. to 37° C. In another embodiment, lysozyme treatment is conducted in a temperature range from 20° C. to 30° C.

In an embodiment, a method of producing a genetically enhanced *Cyanobacterium* sp. uses a concentration of NAC between 0.05 and 1 mg/mL and a concentration of lysozyme between 10 to 60 µg/mL to make *Cyanobacterium* sp. host cells competent to transformation.

In an embodiment, the techniques of pretreating the EPS of ABICyano1 are also used as a step in introducing recombinant nucleic acid sequences, such as plasmids, into other cyanobacterial cells with an EPS. Non-limiting examples of cyanobacteria with an EPS include several *Nostoc* and *Anabaena* strains such as *Nostoc commune, Anabanena cylindrical*, several *Cyanothece* sp. strains, such as *Cyanothece* PCC9224, *Cyanothece* CA 3, *Cyanothece* CE 4, *Cyanothece* ET 5, *Cyanothece* ET 2, and *Cyanospira capsulate* ATCC 43193. Further non-limiting examples of cyanobacteria with an EPS are *Aphanocapsa, Anacystis, Chroococcus, Gloeothece, Microcystis, Synechocystis, Lyngbya, Microcoleus, Oscillatoria, Phormidium, Spirulina, Cyanospira, Scytonema, Tolypothrix, Chlorogloeopsi, Fischerella, Mastigocladus* (see for example: "Exopolysaccharide-producing cyanobacteria and their possible exploitation: A review" Roberto De Philippis et al., *Journal of Applied Phycology* 13: 293-299, 2001, and "Exocellular polysaccharides from cyanobacteria and their possible applications" Roberto De Philippis et al., FEMS Microbiology Reviews 22 (1998) 151-175.

Transformation of ABICyano1 by Conjugation

Attempts at transformation of ABICyano1 by conjugation using methods well known in the art usually resulted in failure. Successful conjugation routinely occurred only after treating the EPS of ABICyano1 according to the methods disclosed herein and then using conjugation techniques well known in the art. In an embodiment, transformation of ABICyano1 with exogenous polynucleotides is performed after treatment of the EPS of ABICyano1 by the conjugation technique as described in Elhai and Wolk, 1988 by using a helper plasmid pRL528.

In certain embodiments, generated plasmids containing oriVT are used for conjugation. The shuttle vectors are transformed into ABICyano1 following a modified conjugation protocol which includes the pretreatment of ABICyano1 to reduce its EPS layer as described herein.

In an embodiment, successful transformation of an exogenous polynucleotide into ABICyano1 occurs using triparental mating with *E. coli* strain J53 bearing a conjugative RP4 plasmid, *E. coli* strain HB101 containing the exogenous cargo to be introduced into ABICyano1 and the pRL528 helper plasmid.

Transformation of ABICyano1 by Electroporation

In an embodiment, electroporation is used for successful transformation of ABICyano1 using, for example, the same plasmids as for conjugation, but with lower efficiency.

As with the conjugation transformation protocol disclosed herein, strain-specific adaptations of standard electroporation protocols may be made to avoid DNA digestion by endogenous restriction enzymes and to allow DNA entry through the EPS layer of ABICyano1 host cells. To achieve successful electroporation, DNA may be protected against endogenous restriction enzymes by methylation. Prior to electroporation using techniques well known in the art, ABICyano1 cells may be pretreated with positively charged polyaminoacids such as poly-L-lysine hydrobromide or poly-L-ornithine hydrochloride or combinations thereof (in particular poly-L-lysine hydrobromide) in order to increase the DNA uptake efficiency.

Selecting for Successful Transformation of ABICyano1

In an embodiment, the presence of a foreign gene encoding antibiotic resistance in a cell is selected by placing putatively transformed cells into a media containing an amount of the corresponding antibiotic and selecting cells that survive. The selected cells are then grown in the appropriate culture medium to allow for further testing.

In another embodiment, colony PCR methods are used to confirm transformants. In certain embodiments of this procedure, three primer sets are used and are directed against parts of the pABICyano1-6.8 shuttle vectors to detect specific fragments of the shuttle vector. Transformants exhibiting the predicted PCR products are analyzed further by plasmid rescue. In one embodiment for plasmid rescue, a 25 mL liquid culture is subjected to DNA isolation.

In a non-limiting example of plasmid rescue, 500 ng to 1 µg of isolated DNA from ABICyano1 transformants containing the transformed plasmids is re-transformed into *E. coli* and usually results in approximately 10-20 transformants per transformation implemented. Plasmid DNA of ten *E. coli* colonies is isolated and analyzed by PCR using specific primers for the transformed plasmids. The plasmid DNA is further analyzed with specific restriction enzymes and then sequenced.

Transformation of p6.8 kb into Other Cyanobacterial Species

In another embodiment, the modified plasmid vector based on the endogenous 6.8 kb plasmid backbone from ABICyano1, in addition to being useful for transformation to other *Cyanobacterium* sp. host cells, is used to transform other cyanobacterial genera. As an example, a shuttle vector containing the 6.8 kb endogenous plasmid from ABICyano1 with a kanamycin resistance cassette ($Km^R$) and the oriVT for replication in *E. coli* is transformed into *Synechococcus* PCC 7002 by natural uptake.

In another embodiment, a modified vector based on the endogenous 6.8 kb plasmid from ABICyano1 is transformed into other genera of cyanobacteria. Examples of cyanobacteria that can be transformed with p6.8 derived vectors disclosed herein include, but are not limited to *Synechocystis, Synechococcus, Acaryochloris, Anabaena, Thermosynechococcus, Chamaesophon, Chroococcus, Cyanobium, Dactylococcopsis, Gloeobacter, Gloeocapsa, Gloeothece, Microcys-* tis, Phrochlorococcus, Prochloron, Chroococcidiopsis, Cyanocystis, Dermocarpella, Myxosarcina, Pleurocapsa, Stanieria, Xenococcus, Arthrospira, Borzia, Crinalium, Geitlerinema, Halospirulina, Leptolyngbya, Limnothrix, Lyngbya, Microcoleus, Cyanodictyon, Aphanocapsa, Oscillatoria, Planktothrix, Prochlorothrix, Pseudanabaena, Spirulina, Starria, Symploca, Trichodesmium, Tychonema, Anabaenospis, Aphanizomenon, Calothrix, Cyanospira, Cylindrospermopsis, Cylindrospermum, Nodularia, Nostoc, Chlorogloepsis, Fischerella, Geitleria, Nostochopsis, Iyengariella, Stigonema, Rivularia, Scytonema, Tolypothrix, Cyanothece, Phormidium, Adrianema, and the like.

Promoters

In an embodiment, any desired promoter can be used to regulate the expression of the genes for the production of a desired compound in ABICyano1. Exemplary promoter types include but are not limited to, for example, constitutive promoters, inducible promoters (e.g., by nutrient starvation, heat shock, mechanical stress, environmental stress, metal concentration, light exposure, etc.), endogenous promoters, heterologous promoters, and the like.

In an embodiment, recombinant genes are placed under the transcriptional control (operably linked) of one or more promoters selected from $P_{rbcLS}$, $P_{ntcA}$, $P_{nblA}$, $P_{isiA}$, $P_{petJ}$, $P_{petE}$, $P_{corT}$, $P_{smtA}$, $P_{ziaA}$, $P_{sigB}$, $P_{lrtA}$, $P_{htpG}$, $P_{hspA}$, $P_{clpB1}$, $P_{hliB}$, $P_{ggpS}$, $P_{psbA2}$, $P_{psaA}$, $P_{nirA}$, $P_{narB}$, $P_{nrtA}$, $P_{isiB}$, $P_{nrsB}$, $P_{lrtA}$, $P_{mrgA}$, $P_{pstS}$, and $P_{crhC}$. In an embodiment, synthetic promoters are used.

Recombinant genes disclosed herein may be regulated by one promoter, or they can each be regulated by individual promoters. The promoters can be constitutive or inducible. The promoter sequences can be derived, for example, from the host cell, from another organism, or can be synthetically derived.

Exemplary promoters for expression in cyanobacteria include, but are not limited to, $P_{petJ}$, $P_{psbD}$, $P_{nblA}$, $P_{rpoA}$, $P_{isiB}$, $P_{rbcLS}$, $P_{ntcA}$, $P_{nblA}$, $P_{isiA}$, $P_{petJ}$, $P_{corT}$, $P_{smtA}$, $P_{ziaA}$, $P_{sigB}$, $P_{lrtA}$, $P_{htpG}$, $P_{hspA}$, $P_{clpB1}$, $P_{hliB}$, $P_{ggpS}$, $P_{psbA2}$, $P_{psaA}$, $P_{nirA}$, $P_{narB}$, $P_{nrtA}$, $P_{crhC}$, and additional metal ion inducible promoters and the like. Examples of constitutive promoters that can be used include, but are not limited to, $P_{rbcL}$, $P_{rnpA}$, $P_{rpsL}$, $P_{rpoA}$, $P_{psaA}$, $P_{psbA2}$, $P_{psbD}$, $P_{cpcB}$.

The promoters hspA, clpB1, and hliB can be induced by heat shock (raising the growth temperature of the host cell culture from 30° C. to 40° C.), cold shock (reducing the growth temperature of the cell culture from 30° C. to 20° C.), oxidative stress (for example by adding oxidants such as hydrogen peroxide to the culture), or osmotic stress (for example by increasing the salinity). The promoter sigB can be induced by stationary growth, heat shock, and osmotic stress. The promoters ntcA and nblA can be induced by decreasing the concentration of nitrogen in the growth medium and the promoters psaA and psbA2 can be induced by low light or high light conditions. The promoter htpG can be induced by osmotic stress and heat shock. The promoter crhC can be induced by cold shock. An increase in copper concentration can be used in order to induce the promoter petE, whereas the promoter petJ is induced by decreasing the copper concentration. Additional details of these promoters can be found, for example, in the patent application PCT/EP2009/060526, which is herein incorporated by reference in its entirety.

In an embodiment, truncated or partially truncated versions of promoters disclosed herein can be used including only a small portion of the native promoters upstream of the transcription start point, such as the region ranging from −35 to the transcription start. Furthermore, introducing nucleotide changes into the promoter sequence, e.g. into the TATA box, the operator sequence and/or the ribosomal binding site (RBS) can be used to tailor or improve the promoter strength and/or its induction conditions, e.g. the concentration of inductor required for induction. For example, the inducible promoter can be $P_{nirA}$, and can be $P_{nirA}$ from ABICyano1, which is repressed by ammonium and induced by nitrite. This promoter may contain nucleotide changes in either one of the ribosomal binding site, the TATA box, the operator, and the 5'-UTR (untranslated region).

In certain embodiments, the present invention includes a polynucleotide comprising or consisting of any of the promoter sequences described herein, or variants thereof, including those having at least 80%, at least 90%, at least 95%, at least 98%, or at least 99% identity to the reference promoter sequence.

In one embodiment, $P_{nirA}$ (SEQ ID NO: 112) can have the following generalized nucleotide sequence:

5'(N)$_{116}$ATGCAAAAAACGAAT(N)$_7$ATGTGTAAAAAGAAA(N)$_{15}$GTAGTCA

AAGITAC(N)$_{22}$TAATGT(N)$_{55}$CCGAGGACAAA(N)$_2$ATG-3'

Each of the nucleotides N is independently selected from a group consisting of A, T, C and G, and the two ATGs in the 5'-region of the promoter are the start for NtcB binding sites and the capital letter GTA is the start for the NtcA binding site, and the bold letters CCG denotes the start of the RBS, and the 3'-ATG is the start codon for the first recombinant gene transcriptionally controlled by this promoter.

Another generalized DNA sequence of promoter nirA (SEQ ID NO: 113) includes nucleotide changes in the ribosomal binding site leading to the following general DNA sequence:

5'(N)$_{116}$ATGCAAAAAACGAAT(N)$_7$ATGTGTAAAAAGAAA(N)$_{15}$GTAGTCA

AAGTTAC(N)$_{22}$TAATGT(N)$_{55}$GGAGGATCAGCC(N)$_2$ATG-3'

The bold and underlined nucleotides denote nucleotide changes in comparison to the native promoter.

In another embodiment, modified promoter nirA (SEQ ID NO: 114) can include changes in the operator region (binding site for NtcB and NtcA) and the TATA box leading to the following general nucleotide sequence:

5'(N)$_{116}$ATGCAAAAAACGCAT(N)$_7$ATGCGTAAAAAGCAT(N)$_{15}$GTA

ATCAAAGTTAC(N)$_{22}$TAATAT(N)$_{55}$CCGAGGACAAA(N)$_2$ATG-3'

The bold and underlined nucleotides denote nucleotide changes in comparison to the native promoter.

Another variant of $P_{nirA}$ (SEQ ID NO: 115) combines the above changes and has the following DNA sequence:

5'(N)$_{116}$ATGCAAAAAACGCAT(N)$_7$ATGCGTAAAAAGCAT(N)$_{15}$GTA

ATCAAAGTTAC(N)$_{22}$TAATAT(N)$_{55}$GGAGGATCAGCC(N)$_2$ATG-3'

Another embodiment of the disclosure provides the $Co^{2+}$ inducible promoter corT (SEQ ID NO: 116), which has the general nucleotide sequence of:

5'CAT(N)$_7$GTTTACTCAAAACCTTGACATTGACACTATGTTGGTTTA

GGCT(N)$_{15}$CAAGTTAAAAAGCATG-3',

Each of the nucleotides N is independently selected from a group consisting of A, T, C and G, and the 5'-CAT is the start codon of corR (antisense orientation), the 3'ATG is the start codon for the first recombinant gene transcriptionally controlled by this promoter.

A modified variant of $P_{corT}$ (SEQ ID NO: 117) includes changes in the RBS having the following nucleotide sequence:

5'CAT(N)$_7$GTTTACTCAAAACCTTGACATTGACACTAATGTTAAGGTTTA

GGCT(N)$_{15}$GAGGATAAAAAGCATG-3',

The bold and underlined nucleotides denote nucleotide changes in comparison to the native promoter.

In an embodiment, another variant of $P_{corT}$ (SEQ ID NO: 118) includes changes in the TATA box having the general DNA sequence of:

5'CAT(N)$_7$GTTTACTCAACCTTGACATTGACACTAATGTTAGGTTTA

GAAT(N)$_{15}$CAAGTTAAAAAGCATG-3',

The bold and underlined nucleotides denote nucleotide changes in comparison to the native promoter.

In another embodiment, a modified corT promoter (SEQ ID NO: 119) combines the above mentioned two modifications to the RBS and the TATA box, and has the following DNA sequence:

5'CAT(N)$_7$GTTTACTCAAACCTTGACATTGACACTTGTTAAGGTTTA

GAAT(N)$_{15}$GAGGATAAAAAGCATG-3'

In yet another embodiment, the $Zn^{2+}$ inducible promoter smtA (SEQ ID NO: 120) from Synechococcus sp. PCC 7002 can be used having the following general nucleotide sequence:

5'(N)$_8$AATACCTGAATAATTGtTCATGTGtT(N)$_4$TAAAAATGTGAACAAT

CGTTCAACTATTTA(N)$_{12}$GGAGGT(N)$_7$ATG-3'

In an embodiment, changes in the ribosomal binding site can lead to the following generalized nucleotide sequences of $P_{smtA}$ SEQ ID NO: 121 and SEQ ID NO: 122, respectively:

5'(N)$_8$AATACCTGAATAATTGTTCATGTGTT(N)$_4$TAAAAATGTGAACAAT

CGTTCAACTATTTA(N)$_{10}$AAGGAGGTGAT(N)$_4$ATG-3', or

5'(N)$_8$AATACCTGAATAATTGTTCATGTGTT(N)$_4$TAAAAATGTGAACAAT

CGTTCAACTATTTA(N)$_{10}$AAGGAGGTAT(N)$_5$ATG-3'

The bold and underlined nucleotides denote nucleotide changes in comparison to the native promoter.

In an embodiment, disclosed herein are recombinant genes of a shuttle vector that comprise or are operably linked to an inducible promoter and/or a constitutive promoter. The promoter can be upstream of one gene to regulate that gene, or the promoter can be upstream of several genes so that one promoter regulates the expression of more than one gene. Alternatively, in some embodiments, each recombinant gene can be regulated by a separate promoter. In an embodiment, the promoter can be derived from a cyanobacterial host cell, can be derived from another cyanobacterial species, or can be derived from another organism.

In an embodiment, a promoter controlling the transcription of at least one recombinant gene is a cyanobacterial promoter. In an embodiment, cyanobacterial promoters include, but are not limited to, promoter psbA2 from Synechocystis sp. PCC 6803, promoter cpcBA from Synechocystis sp. PCC 6803, $P_{rpsL}$ and $P_{nblA7120}$ from Nostoc sp. PCC 7120, $Pr_{bcL6803}$ from Synechocystis sp. PCC 6803 and the $P_{smtA1535}$ promoter from Synechococcus sp. PCC 7002.

In another embodiment, a promoter used herein is a heterologous promoter from a different cyanobacterial or bacterial species. For example, the transcriptional regulator gene and promoter combinations of ziaR-$P_{ziaA}$ from Synechocystis sp. PCC6803, smtB-$P_{smtA}$ from Synechococcus sp. PCC 7002, corR-$P_{corT}$ from Synechocystis sp. PCC6803, nrsRS-$P_{nrsB}$ from Synechocystis sp. PCC 6803, and aztR-$P_{aztA}$ from Anabaena (Nostoc) sp. strain PCC 7120 can be used to control the transcription of the at least one recombinant gene in Cyanobacterium sp. such as ABICyano1, for example.

Examples of inducible promoters disclosed herein include, but are not limited to promoter/regulator pair aztR-$P_{aztA}$, which can be activated by adding $Zn^{2+}$; Synechococcus PCC 7002 smtB-$P_{smtA}$ which is induced by $Zn^{2+}$ and corR-$P_{corT}$ by adding $Co^{2+}$; the regulator/promoter combination nrsRS-$P_{nrsB}$ which is induced by the addition of $Ni^{2+}$; and the combination of ziaR-$P_{ziaA}$ with the ziaA promoter and the ziaR repressor which can be induced by the addition of $Zn^{2+}$.

In another embodiment, the promoter smtA, which is endogenous to Synechococcus PCC 7942 and Synechococcus PCC 7002, is used to control the expression of genes encoded on vectors disclosed herein. The gene smtA (SYNPCC7002_A2563), which is transcriptionally controlled by promoter smtA, codes for a metallothionein (YP_001735795.1) involved in resistance to, inter alia, zinc. A repressor protein (YP_001735796.1) binds to $P_{smtA}$ in the uninduced state and is encoded by the gene smtB (SYNPCC7002_A2564).

In an embodiment, promoter aztA from Anabaena PCC 7120 is used to control expression of genes of interest on vectors disclosed herein. In Anabaena PCC 7120, the gene aztA (alr7622) codes for a $Zn^{2+}$, $Cd^{2+}$ and $Pb^{2+}$ transporting ATPase (NP_478269.1) which is transcriptionally controlled by promoter aztA. Promoter aztA is blocked in the uninduced state by a repressor protein (NP_478268.1) encoded by the gene aztR (all7621).

In an embodiment, promoter corT from Synechocystis sp. PCC 6803 is used to control expression of genes of interest on vectors disclosed herein. In Synechocystis sp. PCC 6803, the gene corT (slr0797) encodes a cobalt transporting ATPase (NP_442633.1). This gene is transcriptionally controlled by promoter corT which is transcriptionally controlled by a regulator protein (NP_442632.1) coded by the gene corR (sll0794) which binds to the corT promoter. The promoter corT is one example of a cobalt inducible promoter, whereas promoters ziaA, smtA, and smtB are examples of zinc inducible promoters.

In an embodiment, the tightness and the level of expression of the protein involved in a biosynthetic pathway for the production of a compound or marker protein can be improved through mutations introduced in the TATA-box, the operator sequence and/or the ribosomal binding site of the promoter controlling the recombinant gene. The sequence of the mutated promoter can have at least 90%, at least 95%, at least 98%, or at least 99% sequence identity to an endogenous promoter of ABICyano1 or to another cyanobacterial promoter.

In an embodiment, a promoter disclosed herein can be an inducible promoter selected from the group consisting of $P_{nirA}$, $P_{nrtA}$, and $P_{narB}$ from ABICyano1, for example. In another embodiment, a promoter is a constitutive promoter selected from the group consisting of $P_{rpsL}$, $P_{rbc}$, $P_{cpcB}$ and $P_{petE}$ which can all be endogenous promoters of ABICyano1, for example.

In an embodiment, more than one recombinant gene is used in a recombinant vector. In one embodiment, a first and second recombinant gene can be controlled by one promoter, thereby forming a transcriptional operon. In another embodiment, the first and second recombinant genes are controlled by different first and second promoters. In the case that the first recombinant gene codes for a protein catalyzing a reaction not present in the wild-type Cyanobacterium sp. that directs the carbon flux away from the metabolic pathways of the wild-type Cyanobacterium sp., such as pyruvate decarboxylase, in particular embodiments this gene is controlled by an inducible promoter such as $P_{nirA}$ from ABICyano1. Such a configuration ensures that the gene is only turned on upon induction.

In an embodiment, the recombinant gene under control of the promoter is induced if a sufficiently high culture density of Cyanobacterium sp. is reached. In the case that the second recombinant gene codes for a protein catalyzing a chemical reaction present in the wild-type Cyanobacterium sp., such as alcohol dehydrogenase, the gene can be under the control of either an inducible or a constitutive promoter because it does not disturb the carbon flux to the same extent as the non-native protein encoded by the first recombinant gene. The second recombinant gene then may be under the control of constitutive promoters such as $Pr_{bcL}$, $P_{petE}$, or $P_{rpsL}$, all from ABICyano1, for example.

In an embodiment, a transcription terminator is present between the first and second recombinant gene in order to ensure a separate transcriptional control of the first and second recombinant gene and to provide for a high production of a compound of interest, such as ethanol. In certain embodiments, the present invention includes ethanologenic cassettes. In an embodiment for an ethanologenic cassette used to produce ethanol as a compound of interest, a first recombinant gene encodes pyruvate decarboxylase and the second recombinant gene encodes alcohol dehydrogenase. The first recombinant gene (pdc) is under the transcriptional control of a first inducible promoter and the second recombinant gene (adh) is under the transcriptional control of a second constitutive promoter. The first inducible promoter can be selected from, for example, PnirA, PnirA variants PnirA*2, PnirA*3, PnirA*4, PmntC, PsmtA (Porf3126), Porf221, Porf222, Porf223, Porf316, Porf3232 and Porf3461 and the second constitutive promoter can be selected from, for example, PrpsL, PrpsL*4, Prbc*(optRBS), and PcpcB. The promoter rpsL (SEQ ID NO: 123) controls the transcription of the 30 S ribosomal protein S12 in ABICyano1 and has the following sequence:

5'-
GAGCTCTAGAAAAACTA TTGACA AACCCATAAAAAATGAGA TAAGAT TAT

AGATTGTCACTGGTATTTTATACTAGAGGCAAATTATATTTATATATACA

AAAATGCTGTA TAAAAA ACATCTCATATG-3'

The 3'-ATG is the start codon of the gene controlled by the rpsL promoter, the boxed sequence TAAAAA is the ribosomal binding site and the other boxed sequences are the regions for the binding of the regulator and the TATA box.

The following modified promoter sequence PrpsL*4 (SEQ ID NO: 124) contains modifications in the regulator binding sites and the ribosomal binding site as indicated by the bold-faced underlined nucleotides: 5'-

GAGCTCTAGAAAAACTA TTGACA AACCCATAAAAAATGTGA TATAAT TAT

AGATTGTCACTGGTATTTTATACTAGAGGCAAATTATATTTATATATACA

AAAATGCTGTA GGAGGA TCAGCCATATG-3'

In an embodiment, a non-naturally occurring ABICyano1 host cell comprising any of the ethanologenic cassettes described herein produces ethanol in quantities of at least 0.012% (v/v) per day, at least 0.025% (v/v) per day, preferably at least 0.03% (v/v) per day, most preferred at least 0.094% (v/v) per day. In certain other embodiments, the transcription of both the first and second recombinant gene encoding the pyruvate decarboxylase enzyme and the recombinant gene encoding the alcohol dehydrogenase enzymes are controlled by the same single promoter. For these embodiments, an inducible promoter may be used. In such a case, the second recombinant gene encoding the alcohol dehydrogenase may be arranged upstream of the first recombinant gene encoding the pyruvate decarboxylase enzyme, so that transcription of the alcohol dehydrogenase gene occurs before transcription of the pyruvate decarboxylase gene. In this way, a delay in ADH enzyme expression relative to PDC enzyme expression can be avoided and a sufficiently high ADH enzyme expression level of ADH can be accomplished, so that transient acetaldehyde accumulation is effectively reduced.

In an embodiment, a transcription terminator is present between the first and second recombinant gene in order to ensure a separate transcriptional control of the first and second recombinant gene and to provide for a high production of a compound of interest, such as ethanol. In an embodiment for an ethanologenic cassette used to produce ethanol as a compound of interest, a first recombinant gene encodes pyruvate decarboxylase and the second recombinant gene encodes alcohol dehydrogenase. In particular embodiments, the first recombinant gene (pdc) is under the transcriptional control of a first inducible promoter and the second recombinant gene (adh) is under the transcriptional control of a second constitutive promoter.

Promoter elements disclosed herein may be operably linked with any genes encoding any enzymes useful for the production of compounds of interest by using standard molecular cloning techniques.

Endogenous Promoters from ABICyano1

In an embodiment, promoters used herein can be endogenous to ABICyano1. In another embodiment endogenous promoters from ABICyano1 can be modified in order to increase or decrease efficiency and/or promoter strength. In an embodiment, endogenous promoters used to control the expression of genes on vectors disclosed herein include, but are not limited to promoter cpcB from ABICyano1 (SEQ ID NO: 9), promoter nirA (SEQ ID NO: 10) from ABICyano1 promoter lrtA (SEQ ID NO: 11) (light-repressed protein, ribosomal subunit interface protein) from ABICyano1, promoter mrgA (SEQ ID NO: 12) (214 bp) from ABICyano1, promoter nblA (SEQ ID NO: 13) (338 bp) from ABICyano1, promoter ggpS (glucosylglycerol-phosphate synthase) (SEQ ID NO: 14) (408 bp) from ABICyano1, promoter petJ (SEQ ID NO: 15) (411 bp) from ABICyano1, promoter ppsA (phosphoenolpyruvate synthase gene) (SEQ ID NO: 16) (211 bp) from ABICyano1, promoter rnpA (Ribonuclease P) (SEQ ID NO: 17) (542 bp) from ABICyano1, promoter pstS (SEQ ID NO: 18) (380 bp) from ABICyano1.

RNA-Seq experiments were conducted on ABICyano1 in order to identify potential metal-ion inducible promoters in ABICyano1. In an embodiment, the upstream regions of metal ion responding/inducible genes in ABICyano1, listed in table 2 below, were selected to drive/control expression of an ethanologenic gene cassette in ABICyano1. The nucleic acid sequences of the promoters are provided for in the sequence listing corresponding to SEQ ID NOs 19-41. All of the potential inducible promoters may be used for the transcriptional control of at least one recombinant gene.

TABLE 2

| Gene_id | Promoter Sequence | Homology | Inducible by |
|---|---|---|---|
| ABICyano1_orf0128 | SEQ ID NO: 19 | hypothetical protein | nickel |
| ABICyano1_orf1486 | SEQ ID NO: 20 | putative nickel-containing superoxide dismutase | nickel |
| ABICyano1_orf3164 | SEQ ID NO: 21 | ferrochelatase | nickel |
| ABICyano1_orf3293 | SEQ ID NO: 22 | hypothetical protein L8106_16134 | nickel |
| ABICyano1_orf3621 | SEQ ID NO: 23 | hypothetical protein Cyan7822_1798 | nickel |
| ABICyano1_orf3635 | SEQ ID NO: 24 | carbohydrate-selective porin | nickel |
| ABICyano1_orf3858 | SEQ ID NO: 25 | manganese/iron superoxide dismutase-like protein | nickel |
| ABICyano1_orf1071 | SEQ ID NO: 26 | Mn transporter | zinc |
| ABICyano1_orf1072 | SEQ ID NO: 27 | ABC transporter family protein | zinc |
| ABICyano1_orf1074 | SEQ ID NO: 28 | ABC 3 transport family | zinc |
| ABICyano1_orf1075 | SEQ ID NO: 29 | No hits found -\|- KEGG: -\|- CyanoBase | zinc |
| ABICyano1_orf1542 | SEQ ID NO: 30 | hypothetical protein PCC8801_4423 | zinc |
| ABICyano1_orf1823 | SEQ ID NO: 31 | RNA polymerase sigma factor | zinc |
| ABICyano1_orf1824 | SEQ ID NO: 32 | No hits found -\|- KEGG: -\|- CyanoBase | zinc |
| ABICyano1_orf3126 | SEQ ID NO: 33 | Metallothionein | zinc |
| ABICyano1_orf3389 | SEQ ID NO: 34 | HtrA2 peptidase | zinc |
| ABICyano1_orf0221 | SEQ ID NO: 35 | CopA family copper-resistance protein | copper |
| ABICyano1_orf0222 | SEQ ID NO: 36 | copper resistance B | copper |
| ABICyano1_orf0223 | SEQ ID NO: 37 | No hits found -\|- KEGG: -\|- CyanoBase | copper |
| ABICyano1_orf0316 | SEQ ID NO: 38 | hypothetical protein CY0110_11047 | copper |
| ABICyano1_orf3232 | SEQ ID NO: 39 | cation-transporting ATPase | copper |
| ABICyano1_orf3461 | SEQ ID NO: 40 | petJ | copper |
| ABICyano1_orf3749 | SEQ ID NO: 41 | conserved hypothetical protein | cobalt |

Codon Improvement of Recombinant Genes

At least some of the nucleic acid sequences to be expressed in cyanobacterial host cells can be codon improved for optimal expression in the target cyanobacterial strain. The underlying rationale is that the codon usage frequency of highly expressed genes is generally correlated to the host cognate tRNA abundance. (Bulmer, Nature 325:728-730; 1987). Codon improvement (sometimes referred to as codon optimization or codon adaptation) can be performed to increase the expression level of foreign genes such as antibiotic resistance genes, ethanologenic (or other compounds of interest) cassettes, and any other expressed genes on a plasmid, for example.

Codon improvement of heterologously derived genes (such as genes encoding antibiotic resistance genes, and the recombinant production genes, such as genes in an ethanologenic cassette) was conducted using the software Gene Designer (DNA 2.0, Menlo Park, Calif.), and was guided by the ABICyano1 codon usage table derived from ribosomal proteins and highly expressed genes (such as photosynthesis genes). To improve heterologous gene expression, original sequences of interest (such as *Z. mobilis* pdc and *Synechocystis* PCC 6803 adh) were assessed with the online software OPTIMIZER (Puigbó P, Guzmán E, Romeu A, & Garcia-Vallvé S (2007) OPTIMIZER: a web server for optimizing the codon usage of DNA sequences *Nucleic Acids Research* 35(suppl 2):W126-W131) based on the codon-usage table derived from ABICyano1 genome. The pre-optimized sequences were further modified with Gene Designer 2.0 (available at dna20.com/genedesigner2/) to ensure that their codon adaptation index (Sharp PM & Li W-H (1987).

The codon adaptation index is a measure of directional synonymous codon usage bias, and its potential applications, (see Nucleic Acids Research 15(3):1281-1295). The effective number of codons (see, Wright F (1990) Gene 87(1):23-29) are designed match those of highly expressed genes (such as ribosomal proteins) in the ABICyano1 genome. The resulting polynucleotides using improved codons were further modified and optimized to avoid the presence of any known or predicted putative ABICyano1 endonuclease restriction sites (AvaI, BsaHI, KasI, XhoI etc.); internal Shine-Dalgarno sequence and RNA destabilizing sequences; an internal terminator sequence; and a repeat sequence of greater than about 10 bp (see, Welch et al., PLOS One 4, e7002; 2009; and Welch et al., Journal of the Royal Society; Interface 6 (Suppl 4), S467-S476; 2009).

In an embodiment, the nucleic acid sequences of the recombinant genes are modified so that they will have improved expression in cyanobacteria. For example, the selectable marker gene that confers gentamycin or kanamycin resistance was codon optimized for higher expression in cyanobacteria. Additionally, the selectable marker gene that confers kanamycin resistance was codon optimized for higher expression in cyanobacteria. In an embodiment, as a result of codon improvement, the GC % of the antibiotic resistance genes decreased from 40-53% to 33-40%, which is similar to that of ABICyano1 coding genes (about 36% on average). The codon adaptation index of the codon improved antibiotic resistance genes is significantly improved from less than 0.4 to greater than 0.8, which is similar to that of ABICyano1 endogenous genes.

Table 3 depicts the codon usage statistics within ABICyano1.

TABLE 3

| Amino Acid | Codon | Fraction | Number | Frequency (/1000) |
|---|---|---|---|---|
| Ala | GCA | 0.293 | 20724 | 18.356 |
| Ala | GCC | 0.214 | 15144 | 13.414 |
| Ala | GCG | 0.14 | 9870 | 8.742 |
| Ala | GCT | 0.353 | 24915 | 22.068 |

TABLE 3-continued

| Amino Acid | Codon | Fraction | Number | Frequency (/1000) |
|---|---|---|---|---|
| Arg | AGA | 0.347 | 16040 | 14.207 |
| Arg | AGG | 0.09 | 4158 | 3.683 |
| Arg | CGA | 0.106 | 4886 | 4.328 |
| Arg | CGC | 0.131 | 6043 | 5.353 |
| Arg | CGG | 0.039 | 1813 | 1.606 |
| Arg | CGT | 0.288 | 13329 | 11.806 |
| Asn | AAC | 0.22 | 14609 | 12.94 |
| Asn | AAT | 0.78 | 51712 | 45.804 |
| Asp | GAC | 0.193 | 11063 | 9.799 |
| Asp | GAT | 0.807 | 46399 | 41.098 |
| Cys | TGC | 0.218 | 2501 | 2.215 |
| Cys | TGT | 0.782 | 8976 | 7.95 |
| Gln | CAA | 0.806 | 43747 | 38.749 |
| Gln | CAG | 0.194 | 10554 | 9.348 |
| Glu | GAA | 0.787 | 60690 | 53.756 |
| Glu | GAG | 0.213 | 16451 | 14.571 |
| Gly | GGA | 0.324 | 22709 | 20.114 |
| Gly | GGC | 0.125 | 8720 | 7.724 |
| Gly | GGG | 0.151 | 10542 | 9.338 |
| Gly | GGT | 0.401 | 28065 | 24.859 |
| His | CAC | 0.251 | 4859 | 4.304 |
| His | CAT | 0.749 | 14516 | 12.858 |
| Ile | ATA | 0.195 | 18334 | 16.239 |
| Ile | ATC | 0.19 | 17872 | 15.83 |
| Ile | ATT | 0.616 | 57964 | 51.342 |
| Leu | CTA | 0.088 | 10776 | 9.545 |
| Leu | CTC | 0.058 | 7129 | 6.314 |
| Leu | CTG | 0.033 | 4040 | 3.578 |
| Leu | CTT | 0.116 | 14162 | 12.544 |
| Leu | TTA | 0.571 | 69559 | 61.612 |
| Leu | TTG | 0.133 | 16235 | 14.38 |
| Lys | AAA | 0.836 | 59396 | 52.61 |
| Lys | AAG | 0.164 | 11694 | 10.358 |
| Met | ATG | 1 | 20093 | 17.797 |
| Phe | TTC | 0.172 | 8420 | 7.458 |
| Phe | TTT | 0.828 | 40450 | 35.829 |
| Pro | CCA | 0.169 | 7746 | 6.861 |
| Pro | CCC | 0.275 | 12613 | 11.172 |
| Pro | CCG | 0.066 | 3012 | 2.668 |
| Pro | CCT | 0.491 | 22560 | 19.982 |
| Ser | AGC | 0.088 | 6435 | 5.7 |
| Ser | AGT | 0.306 | 22393 | 19.835 |
| Ser | TCA | 0.14 | 10217 | 9.05 |
| Ser | TCC | 0.102 | 7465 | 6.612 |
| Ser | TCG | 0.044 | 3196 | 2.831 |
| Ser | TCT | 0.321 | 23473 | 20.791 |
| Thr | ACA | 0.26 | 15649 | 13.861 |
| Thr | ACC | 0.236 | 14251 | 12.623 |
| Thr | ACG | 0.083 | 5024 | 4.45 |
| Thr | ACT | 0.42 | 25340 | 22.445 |
| Trp | TGG | 1 | 14964 | 13.254 |
| Tyr | TAC | 0.187 | 7364 | 6.523 |
| Tyr | TAT | 0.813 | 31912 | 28.266 |
| Val | GTA | 0.28 | 18541 | 16.423 |
| Val | GTC | 0.117 | 7778 | 6.889 |
| Val | GTG | 0.184 | 12184 | 10.792 |
| Val | GTT | 0.419 | 27713 | 24.547 |
| End | TAA | 0.63 | 2495 | 2.23 |
| End | TAG | 0.22 | 848 | 0.76 |
| End | TGA | 0.15 | 591 | 0.53 |

In a further embodiment, the gene (adh) that encodes alcohol dehydrogenase was codon improved for higher expression in cyanobacteria, namely ABICyano1, and the gene (pdc) that encodes pyruvate decarboxylase was codon improved for higher expression in cyanobacteria, namely ABICyano1. In another embodiment, the gene that encodes the GFP marker was also codon optimized for higher expression in cyanobacteria.

Restriction Systems in *Cyanobacterium* sp. ABICyano1

Restriction systems are barriers for the introduction of DNA in cyanobacteria. Foreign DNA is degraded by restriction enzymes and other non-specific nucleases during its entry into a cell. An understanding of the restriction systems is therefore critical in developing new transformation systems and protocols, especially in uncharacterized bacteria.

In a cyanobacterial cell, restriction systems occur in pairs comprising a restriction enzyme (restriction endonuclease) and a specific DNA methyltransferase. Methylation of the restriction enzyme recognition sequence protects DNA in the cell from degradation by the corresponding restriction enzyme. In natural systems, this is one mechanism of protecting the cell from foreign invasion.

Different cyanobacterial cells have different restriction systems. Knowing which restriction systems exist in a given host cell can allow one to protect foreign plasmid DNA prior to entry into the cell by treating it with either a specific methylase, or a general methylase, that allows for protection of the DNA from degradation by the host cell's restriction enzyme(s). This type of DNA methylation can provide an effective protection against restriction barriers during the transformation or conjugation process. The selection of suitable DNA methyltransferases relies on the thorough understanding of the restriction enzyme repertoire of the organism. Since restriction enzymes and DNA methyltransferases occur in pairs, identification of the restriction enzymes implies the existence and specificity of the corresponding DNA methyltransferases.

ABICyano1 was found to have an endogenous restriction enzyme system. This was initially observed using sequence analysis, which predicted the presence of AvaI and HgiD1 (AcyI) in ABICyano1. Subsequent detection of restriction activity in ABICyano1 crude extracts. confirmed this finding. As a result of detecting restriction activity, the appropriate methylating agent can be added to protect foreign genes from being degraded soon after entry into the cell. In an embodiment, methylation is performed in vivo during conjugation using a "helper plasmid" having genes encoding specific methylases that are capable of protecting the identified restriction sites from degradation. In another embodiment, nucleic acid constructs to be transferred to ABICyano1 are first incubated with methylases and then these methylated nucleic acid constructs are transformed into ABICyano1.

Figure 6:
FIG. 6 depicts an image of an agarose gel having undergone electrophoresis to show how methylation of a plasmid only containing antibiotic resistance genes may at least partially protect it from digestion by a crude extract of ABICyano1.
Figure 55:
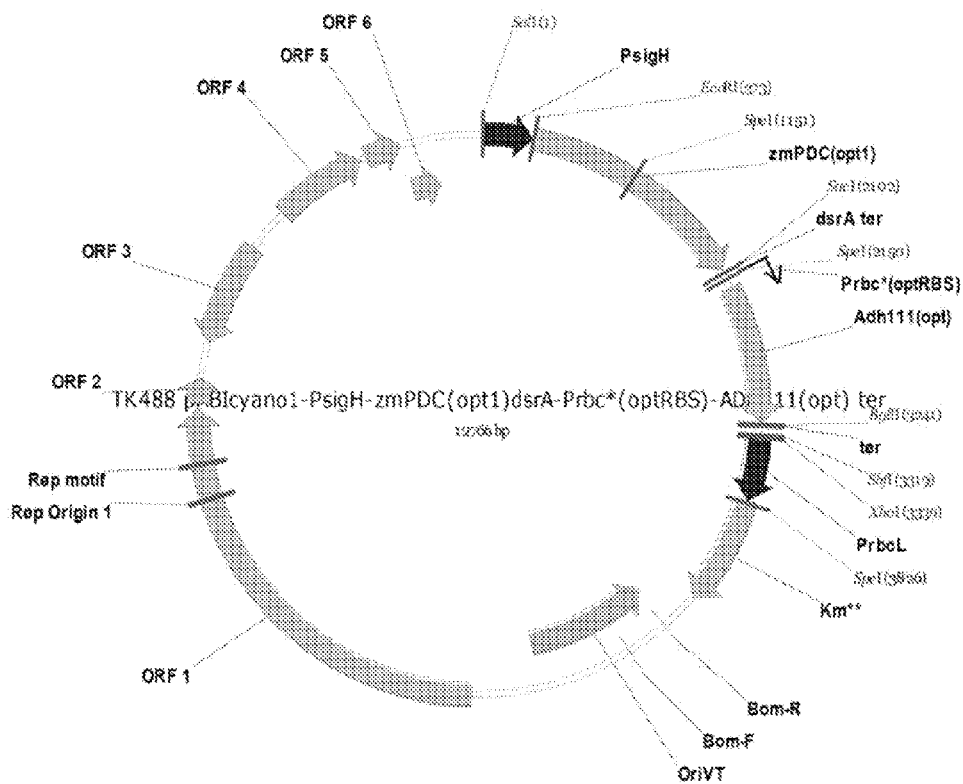
FIG. 55 depicts a plasmid map with sequence annotation for TK488 (pABIcyano1-PsigH-zmPDC(opt1)dsrA-Prbc*(optRBS)-ADH111(opt)_ter).

FIG. 6 depicts an image of an agarose gel having undergone electrophoresis to show how methylation of a plasmid only containing antibiotic resistance genes may at least partially protect it from digestion by a crude extract of ABICyano1. A plasmid including AvaI and AcyI (BsaHI) restriction sites, was incubated with ABICyano1 crude extract, either with or without methylation to protect the plasmid (first plasmid: AvaI: 2×, AcyI: 2×). From left to right; lane 1: plasmid without crude extract, lane 2: methylated plasmid without crude extract, lane 3: plasmid with crude extract (digestion), lane 4: methylated plasmid with crude extract. Thus, as depicted in FIG. 55, the plasmid was fully protected from digestion by the methylation procedure.

Restriction enzymes whose recognition sites contain a CG stretch might be impaired or blocked in cleavage by use of the CG-methylase M.SssI which methylates cytosine at the C5 position. AcyI and AvaI, which were detected in the ABICyano1 crude extract, recognize GRCGYC and CYCGRG, respectively. For example, pRL528, a helper plasmid for conjugal transfer, as described in Elhai and Wolk, 1988, can be used for in vivo methylation of the vectors to be transferred to *Cyanobacterium* sp., in particular ABICyano1. Helper plasmid pRL528 includes the M. AvaI gene coding for the methyltransferase protecting against the restriction endonuclease AvaI and the respective gene coding for M. AvaII. The latter is not required for transformation of ABICyano1, as it lacks AvaII endonuclease activity.

Transformed ABICyano1

In an embodiment, genetically enhanced *Cyanobacterium* sp. host cells, in particular ABICyano1 host cells, include at least one recombinant gene encoding at least one protein that is involved in a biosynthetic pathway for the production of a compound or marker protein. In certain embodiments, they comprise an ethanologenic cassette. In certain embodiments, the genetically enhanced *Cyanobacterium* host cells can be used for the production of various compounds of interest by culturing the host cells under harsh conditions of high temperature, high oxygen levels and in the case of the compound being ethanol, under high levels of ethanol the medium. In an embodiment, a marker protein, or reporter protein, can be a fluorescent protein, such as a red or green fluorescent protein. In an embodiment, a marker protein, or reporter protein, can be a marker gene conferring resistance to a biocide such as an antibiotic which can be used to select for and Maintain cultures of *Cyanobacterium* sp. host cells in the presence. of other bacterial contaminating strains.

In another embodiment, a recombinant gene is present on an extrachromosomal plasmid that can replicate independently from the chromosomes of the *Cyanobacterium* sp. host cells such as ABICyano1. In an embodiment, the extrachromosomal plasmids described herein are present in high copy numbers in the host cells so that a compound of interest can be produced in a high yield.

Genetically enhanced *Cyanobacterium* sp., for example ABICyano1 host cells, can include further genetic enhancements such as partial deletions of endogenous genes of *Cyanobacterium* sp. or other recombinant genes which can increase the overall yield of the compound being produced by the host cells. For example, if the compound to be produced is ethanol, the genetic enhancements can relate to the knock out of endogenous genes coding for enzymes converting pyruvate or acetyl-CoA into a reserve or storage compound. In another embodiment, if the compound to be produced is ethanol, the genetic enhancements can relate to the overexpression of enzymes of the glycolysis pathway. Calvin-cycle, amino acid metabolism, the fermentation pathway, the citric acid cycle, and other intermediate steps of metabolism in order to increase the production of ethanol by the *Cyanobacterium* sp. host cells. Examples of such genetic enhancements are described in PCT patent publication number WO 2009/098089 A2 starting from page 70 and following, which is hereby incorporated by reference for this purpose.

In another embodiment, genetic enhancements of the genes encoding enzymes of the carbon fixation and subsequent carbohydrate metabolism (for example, pathways which compete with an ethanol production pathway) can be genetically enhanced to further increase the production of a compound of interest. Genetic enhancement targets include, but are not limited to, components of the photosystems (antennas and pigment modification), and components of the photosynthetic and respiratory electron transport systems. Genetic enhancement targets include local and global regulatory factors including, but not limited to, the two component system, sigma factors, small regulating RNAs and antisense RNAs.

In an embodiment, *Cyanobacterium* sp. host cells, e.g., ABICyano1 host cells, contain knockout mutations of endogenous genes that do not affect the toleration of being cultured in at least one of the following conditions: 1% (v/v) ethanol in the medium for at least 6, 12 or 16 weeks: 48° C., 50° C., 53 to 55° C. for at least 2 hours per day over a time period of at least 7 days, purging with 60% to 80% (v/v) oxygen (resulting in oxygen concentrations of up to 1000 µmol/L in the culture during the day).

Compounds of Interest Produced by ABICyano1

In certain embodiments, a variety of different compounds of interest can be produced using genetically enhanced ABI-Cyano1 host cells. Plasmid vectors disclosed herein (e.g., derivatives of p6.8) can be used to carry a gene or genes involved in various biosynthetic pathways that produce a compound of interest in the ABICyano1 cell. Exemplary compounds of interest include, but are not limited to, organic carbon compounds, alcohols, fatty acids, oils, carotenoids, proteins, enzymes, biofuels, nutraceuticals, pharmaceuticals, and the like. Additional information on compounds that can be produced from cyanobacteria can be found, for example, in PCT/EP2009/000892 and in PCT/EP2009/060526, both of which are incorporated by reference herein in their entirety. Genes involved in the biosynthetic pathway for the production of a compound of interest can be inserted into the vector.

In one embodiment, propanol and butanol are compounds of interest. Similar to ethanol, they can be produced by fermentation processes. In certain embodiments, genes encoding enzymes involved in isopropanol and isobutanol fermentation are incorporated into recombinant vectors and transformed into ABICyano1. Examples of enzymes involved in isopropanol fermentation include acetyl-CoA acetyltransferase (EC 2.3.1.9), acetyl-CoA:acetoacetyl-CoA transferase (EC 2.8.3.8), acetoacetate decarboxylase (EC 4.1.1.4) and isopropanol dehydrogenase (EC 1.1.1.80). Examples of enzymes involved in isobutanol fermentation include acetolactate synthase (EC 2.2.1.6), acetolactate reductoisomerase (EC 1.1.1.86), 2,3-dihydroxy-3-methylbutanoate dehydratase (EC 4.2.1.9), α-ketoisovalerate decarboxylase (EC 4.1.1.74), and alcohol dehydrogenase (EC 1.1.1.1).

In another embodiment, ethylene is produced as a compound of interest. In an embodiment, at least one recombinant gene encodes an enzyme for ethylene formation. Examples of enzymes involved in the production of ethylene include ethylene forming enzyme 1-aminocyclopropane-1-carboxylate oxidase (EC 1.14.17.4), which catalyzes the last step of ethylene formation, the oxidation of 1-aminocyclopropane-1-carboxylic acid to ethylene. The substrate for the ethylene forming enzyme is synthesized by the enzyme 1-aminocyclopropane-1-carboxylic acid synthase (EC 4.4.1.14) from the amino acid methionine.

In another embodiment, the compound of interest is isoprene. In an embodiment the recombinant vector used to transform a cyanobacterial host cell for the production of isoprene includes at least one recombinant gene encoding an enzyme such as isoprene synthase. Isoprene synthase (EC 4.2.3.27) catalyzes the chemical reaction from dimethylallyl diphosphate to isoprene and pyrophosphate.

In another embodiment, compounds of interest are teipenes and teipenoids. Terpenes are a large and very diverse class of organic compounds, produced primarily by a wide variety of plants, particularly conifers. Terpenes are derived biosynthetically from units of isoprene and are major biosynthetic building blocks in nearly every living organism. For example, steroids are derivatives of the tritemene squalene. When terpenes are modified chemically, such as by oxidation or rearrangement of the carbon Skeleton, the resulting compounds are generally referred to as terpenoids. Terpenes and terpenoids are the primary constituents of the essential oils for many types of plants and flowers. Examples of biosynthetic enzymes are farnesyl diphosphate synthase (EC 2.5.1.1), which catalyzes the reaction of dimethylallyl diphosphate and isopentenyl diphosphate yielding farnesyl diphosphate. Another example is geranylgeranyl diphosphate synthase (EC 2.5.1.29), which catalyzes the reaction between transfarnesyl diphosphate and isopentenyl diphosphate yielding pyrophosphate and geranylgeranyl diphosphate.

In and embodiment, the compound of interest is hydrogen, and the recombinant genes can, for example, encode for hydrogenase. In an embodiment, hydrogenase is an enzyme catalyzing the following reaction: $12H^+ + 12X_{reduced} \rightarrow 6H_2 + 12X_{oxidized}$, where X is an electron carrier such as ferredoxin.

In an embodiment, examples of compounds of interest include non-ribosomal peptides (NRP) and the polyketides (PK). These compounds are synthesized by plants, fungi and only a few bacteria such as actinomycetes, myxobacteria and cyanobacteria. They are a group of structurally diverse secondary metabolites and often possess bioactivities that are of pharmacological relevance. Hybrids of non-ribosomal peptides and polyketides also exist, exhibiting both peptide and polyketide parts. Recombinant genes for the production of non-ribosomal peptides as compounds of interest are encoded by, for example, gene clusters encoding for non-ribosomal peptide synthetases (NRPS). NRPS are characteristic modular multidomain enzyme complexes encoded by modular non-ribosomal peptide synthetase gene clusters. Examples for non-ribosomal peptide synthetases are actinomycin synthetase and gramicidin synthetase.

In an embodiment, polyketides are compounds of interest. In general, there are two distinct groups of polyketides, the reduced polyketides of type I, macrolides, and the aromatic polyketides of type II. Type I polyketides are synthesized by modular polyketide synthases (PKS), which are characteristic modular multidomain enzyme complexes encoded by modular PKS gene clusters. Examples for recombinant genes useful for encoding enzymes for the production of type I polyketides are the rapamycin synthase gene cluster and the oleandomycin synthase gene cluster. One example for a recombinant gene for type II polyketides is the actinorhodin polyketide synthase gene cluster.

In another embodiment, hybrids of polyketides and non-ribosomal peptides are compounds of interest. Examples for recombinant genes for the production of hybrids of polyketides and non-ribosomal peptides are the microcystin synthetase gene cluster, microginin synthetase gene cluster, and myxothiazole synthetase gene cluster.

In another embodiment, alkaloids are compounds of interest. Alkaloids are a group of compounds containing mostly basic nitrogen atoms and which are synthesized by many organisms, including plants. Alkaloids have highly complex chemical structures and pronounced pharmacological activities. Examples for biosynthetic enzymes for alkaloids which can be encoded by recombinant genes for the production of the compound are strictosidine synthase, which catalyzes the reaction of tryptamine and secologanin to form 3a(S)-strictosidine. Strictosidine is a precursor for the biosynthetic pathway of ajmaline and it also initiates all pathways leading to an entire monoterpene indole alkaloid family. Another example of an enzyme that could be encoded by a recombinant gene is strictosidine glucosidase from the ajmaline biosynthetic pathway. This enzyme is able to activate strictosidine by deglycosylation, thus generating an aglycon which is the precursor for more than 2,000 monoterpenoid indole alkaloids.

In an embodiment, additional examples of enzymes encoded by at least one recombinant gene are (R,S)-3'-hydroxy-N-methylcoclaurine 4'-O-methyltransferase (4'OMT) which is central to the biosynthesis of most tetrahydrobenzylisoquinolin-derived alkaloids; berberine bridge enzyme (BBE) of the sanguinarine pathway; (R,S)-reticuline 7-O-methyltransferase (7OMT) part of laudanosine formation; as well as salutaridinol 7-O-acetyltransferase (SalAT) and codeinone reductase involved in the production of morphine.

In yet another embodiment, vitamins are compounds of interest. Vitamins are organic compounds that are essential nutrients for certain organisms and act mainly as cofactors in enzymatic reactions but can also have further importance, e.g. as antioxidants. In plants, vitamin C can be made via the L-ascorbic acid (L-AA) biosynthetic pathway starting from D-glucose. In an embodiment, recombinant genes encoding for enzymes involved in vitamin C synthesis are disclosed and include hexokinase, glucose-6-phosphate isomerase, mannose-6-phosphate isomerase, phosphomannomutase, mannose-1-phosphate guanylyltransferase, GDP-mannose-3,5-epimerase, GDP-L-galactose phosphorylase, L-galactose 1-phosphate phosphatase, L-galactose dehydrogenase, and L-galactono-1,4-lactone dehydrogenase.

In another embodiment amino acids are compounds of interest. Amino acids as compounds of interest include naturally occurring amino acids as well as amino acid derivatives.

In an embodiment, lactams are compounds of interest. Lactams are cyclic amides and the prefix indicates how many carbon atoms (apart from the carbonyl moiety) are present in the ring. For example, β-lactam (2 carbon atoms outside the carbonyl, 4 ring atoms in total), γ-lactam (3 and 5), δ-lactam (4 and 6). One example for a γ-lactam is pyrrolidone, a colorless liquid which is used in industrial settings as a high-boiling, non-corrosive, polar solvent for a wide variety of applications. Pyrrolidone is also an intermediate in the manufacture of polymers such as polyvinylpyrrolidone and polypyrrolidone.

In another embodiment, ethers are compounds of interest. Ethers are a class of organic compounds that contain an ether group, an oxygen atom connected to two alkyl of aryl groups of general formula R-O-R. An example of an ether is tetrahydrofuran (THF) which is a colorless, water-miscible organic liquid. THF is a heterocyclic compound and is one of the most polar ethers miscible in many solvents. THF is also useful as a solvent and as a precursor to polymers. Other examples of ethers that are compounds of interest include natural occurring ethers such as divinyl ether oxylipins. Enzymes involved in the biosynthesis of divinyl ether oxylipins include lipoxygenase and divinyl ether synthase.

In yet another embodiment, alkanes (also known as saturated hydrocarbons) are compounds of interest. Alkanes consist only of the elements carbon (C) and hydrogen (H), i.e. hydrocarbons. When the carbon and hydrogen atoms of alkanes are linked together exclusively by single bonds, the alkanes are saturated alkanes. Each carbon atom must have 4 bonds (either C—H or C—C bonds), and each hydrogen atom must be joined to a carbon atom (H—C bonds). The simplest possible alkane is methane, $CH_4$. There is no limit to the number of carbon atoms that can be linked together. Alkanes, observed throughout nature, are produced directly from fatty acid metabolites. A two gene pathway, widespread in cyanobacteria, is responsible for alkane biosynthesis. In an embodiment, these genes may be part of the recombinant vector and include genes encoding for acyl-ACP reductase (EC 1.3.1.9) which converts a fatty acyl-ACP into a fatty aldehyde that may subsequently be converted into an alkane/alkene by an aldehyde decarbonylase (EC 4.1.99.5)

In an embodiment, biopolymers such as polyhydroxyalkanoates (PHAs) are compounds of interest. PHAs are linear polyesters produced in nature by bacterial fermentation of sugar or lipids. They are produced by the bacteria to store carbon and energy. The simplest and most commonly occurring form of PHA is the fermentative production of poly-3-hydroxybutyrate (P3HB) but many other polymers of this class are produced by a variety of organisms. PHAs include poly-4-hydroxybutyrate (P4HB), polyhydroxyvalerate (PHV), polyhydroxyhexanoate (PHH), polyhydroxyoctanoate (PHO) and their copolymers. In an embodiment, recombinant genes encoding for enzymes involved in P3HB synthesis are part of recombinant vectors. These genes include genes encoding β-ketothiolase (EC 2.3.1.9) that produces acetoacetyl-CoA which is converted to (R)-3-hydroxybutyryl-CoA (3HBCoA) by NADPH-dependent acetoacetyl-CoA reductase (EC 1.1.1.36). The 3HBCoA is subsequently polymerized by poly(3-hydroxyalkanoate) synthase (EC 2.3.1) and is converted to P3HB.

In an embodiment, esters, including fatty acid esters, are a compound of interest. Simple esters with lower chain alcohols (methyl-, ethyl-, n-propyl-, isopropyl- and butyl esters) are used as emollients in cosmetics and other personal care products and as lubricants. Esters of fatty acids with other alcohols, such as sorbitol, ethylene glycol, diethylene glycol and polyethylene glycol are consumed in foods, personal care, paper, water treatment, metal working fluids, rolling oils and synthetic lubricants. Fatty acids are typically present in the raw materials used for the production of biodiesel. A fatty acid ester (FAE) can be created by a transesterification reaction between fats or fatty acids and alcohols. The molecules in biodiesel are primarily fatty acid methyl esters FAMEs, usually obtained from vegetable oils by transesterification with methanol. The esterification of the ethanol with the acyl moieties of coenzyme A thioesters of fatty acids can be obtained enzymatically by a nonspecific long chain alcohol O-fatty-acyltransferase (EC 2.3.1.75) from *Acinetobacter baylyi* strain ADP1, for example.

In an embodiment, *Cyanobacterium* sp. host cells naturally contain the entire sequences of recombinant genes coding for enzymes used for the production of a compound of interest. In another embodiment, the *Cyanobacterium* sp. host cell contains the entire sequences of recombinant genes that encode for all of the enzymes used in a cascade of enzymatically catalyzed reactions that results in the production of a compound of interest.

In an embodiment, a first protein encoded by a first recombinant gene can produce a first intermediate which is further converted by a second protein encoded by a second recombinant gene into a second intermediate, which then in turn is further converted by a third protein encoded by a third recombinant gene into a third intermediate such that a sequence of reactions provide intermediates for the next enzyme leading to the eventual production of a compound of interest. In an embodiment, the recombinant genes encoding for the enzymes that catalyze the sequence of reactions can be introduced into ABICyano1 or other *Cyanobacterium* sp. host cells.

In an embodiment, the compounds of interest that are produced from recombinant ABICyano1 can be removed intermittently as the culture grows, or the compounds can be separated at the end of a batch growth period. The cultures can be grown indoors, or can be grown outdoors in enclosed containers such as bioreactors, or in another suitable type of container.

Production of Ethanol in ABICyano1

In an embodiment, the 6.8 kb endogenous plasmid vector from ABICyano1 is genetically enhanced to include recombinant genes encoding for enzymes that produce a compound of interest. In an embodiment, the 6.8 kb endogenous plasmid vector from ABICyano1 is used as the backbone of a vector useful for introducing exogenous polynucleotides into non-naturally occurring ABICyano1 organisms for the production of a compound of interest.

In an embodiment, a compound of interest is ethanol, and the genetic enhancements to ABICyano1 include transforming with a p6.8 based vector that comprises one or more recombinant genes encoding for an enzyme used in ethanol production. In an embodiment the genes are adh and pdc. The gene pdc encodes for pyruvate decarboxylase (PDC), which catalyzes the interconversion between pyruvate and acetaldehyde. The gene adh encodes for alcohol dehydrogenase (ADH) which catalyzes the interconversion between acetaldehyde and ethanol. Thus, PDC and ADH act in concert to produce ethanol. In another embodiment, the gene is adhE which encodes for AdhE enzyme (alcohol dehydrogenase E) which catalyzes the interconversion between acetyl-coenzyme A and ethanol.

Ethanol produced by non-naturally occurring ABICyano1 organisms can be measured by any means well known in the art. In an embodiment, ethanol produced by ethanologenic non-naturally occurring ABICyano1 organisms is measured using gas chromatographic analysis of a growth media and/or the headspace above a growth media.

In an embodiment, PDC activity is measured by a photometric kinetic reaction that can be monitored at 340 nm using a spectrophotometer. Pyruvate is enzymatically converted to acetaldehyde by pyruvate decarboxylase, which is reduced to ethanol by ethanol dehydrogenase under NADH oxidation. In an embodiment, the PDC enzyme activity is related to the protein content and expressed as the specific activity of PDC.

In particular embodiments, the ADH enzyme is, for example, a $Zn^{2+}$-dependent alcohol dehydrogenase such as AdhI from *Zymomonas mobilis* (ZmAdh) or the Adh enzyme from *Synechocystis* PCC 6803 (SynAdh encoded by the synadh gene). Alternatively or in addition, the enzyme is an iron-dependent alcohol dehydrogenase (e.g. AdhII from *Z. mobilis*). The $Zn^{2+}$-dependent alcohol dehydrogenase can, for example, be an alcohol dehydrogenase enzyme having at least 60%, 70%, 80%, 90% or even more than 90% sequence identity to the amino acid sequence of $Zn^{2+}$ dependent alcohol dehydrogenase from *Synechocystis* PCC 6803. Relative to other alcohol dehydrogenases, SynAdh (annotated open reading frame slr1192 from the *Synechocystis* PCC 6803 genome) favors higher overall ethanol production because the reduction of acetaldehyde to ethanol is preferred to the reaction from ethanol to acetaldehyde. Thus, in an embodiment, a SynAdh encoding recombinant gene is useful for production of ethanol in a host cell.

AdhE is an iron-dependent, bifunctional enzyme that interconverts acetyl coenzyme A to ethanol. One characteristic of iron-dependent alcohol dehydrogenases (e.g. AdhE and AdhII) is their sensitivity to oxygen. In an embodiment, AdhE used to transform ABICyano1 is derived from thermophilic organisms such as *Thermosynechococcus elongatus* BP-1. In another embodiment, AdhE is from *E. coli*. In the case of AdhE from *E. coli*, a mutant was described that exhibited alcohol dehydrogenase activity under aerobic conditions, see Holland-Staley et al., J Bacteriol. 2000 November:182 (21): 6049-54. The E568K AdhE mutant of the *E. coli* AdhE was active both aerobically and anaerobically. Thus, in an embodiment, site-directed mutants of various AdhE enzymes could impart catalytic function to AdhE enzymes under both aerobic and anaerobic conditions in genetically enhanced ABICyano1 host cells.

In an embodiment, pyruvate decarboxylase can, for example, be from *Zymomonas mobilis*, *Zymobacter palmae* or the yeast *Saccharomyces cerevisiae*. In an embodiment, nucleic acid sequences, protein sequences and properties of ethanologenic enzymes such as alcohol dehydrogenases and pyruvate decarboxylases disclosed herein, can be found within PCT patent application WO 2009/098089 A2, which is hereby incorporated for this purpose.

Figure 7:
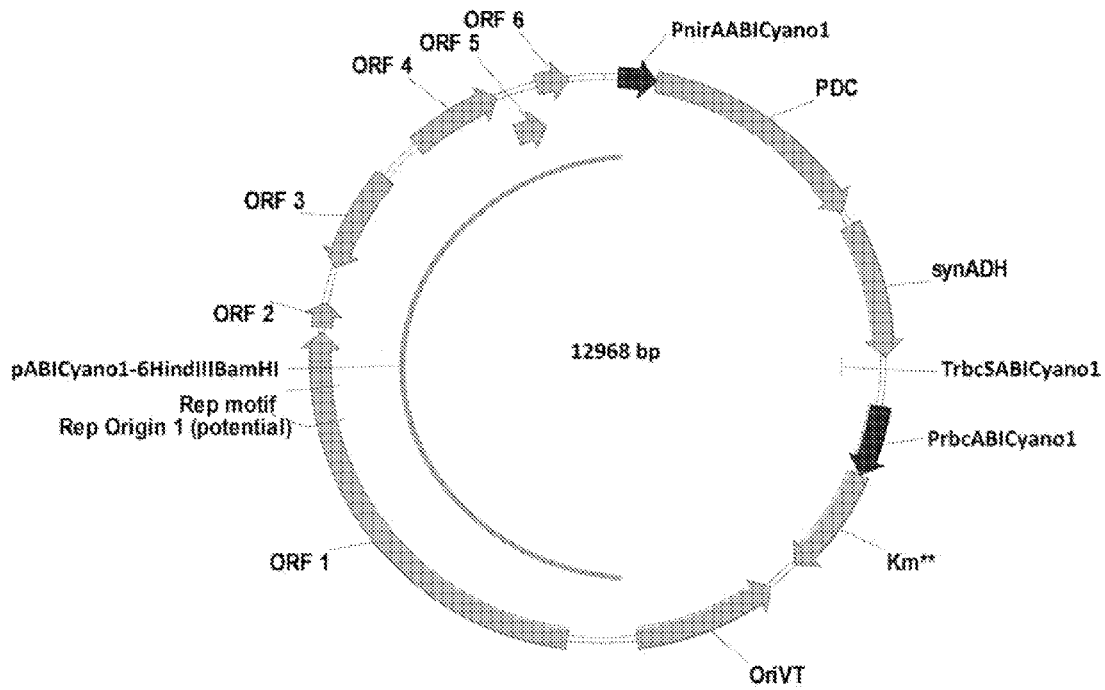
FIG. 7 depicts a map of the plasmid construct and sequence annotation of plasmid TK225 (pABICyano1-6.8 PnirAABICyano1-PDC(opt1)-synADH(opt1)-PrbcABICyano1-Km**-oriVT).

In an embodiment, PDC and ADH are expressed in a genetically enhanced ABICyano1 that produces ethanol. In an embodiment, additional genes that are involved in biosynthetic pathways are inserted. For example, FIG. 7 depicts a map of the plasmid construct TK225 (pABICyano1-6.8 PnirAABICyano1-PDC(opt1)-synADH(opt1)-PrbcABICyano1-Km-oriVT). Its nucleotide sequence is SEQ ID NO: 42. $P_{rbcL}$ from Cyanobacterium sp. ABICyano1 runs from nucleotides 3574 to 4099, the codon improved kanamycin resistance cassette Km is located from nucleotides 4101 to 4916, the origin of replication and transfer oriVT is located from nucleotides 5159 to 6217 in an antisense direction, $P_{nirA}$ runs from nucleotides 96 to 378, the codon improved variant of SynAdh denoted "synADH" is located from nucleotides 2203 to 3210, the codon improved variant from pyruvate decarboxylate runs from nucleotides 379 to 2085. The genes can be codon optimized for optimal expression in ABICyano1 and can utilize any suitable promoter and regulatory sequences.

Ethanologenic Cassettes

In an embodiment, ethanologenic cassettes are introduced into ABICyano1host cells and those ABICyano1 host cells are used for the production of ethanol. Ethanologenic cassettes disclosed herein vary in promoters used as well as the source of adh and pdc genes.

In an embodiment, an ethanologenic gene cassette is codon-optimized for ABICyano1. As described in the examples, two different codon-optimized ethanologenic gene cassettes were used for the transformation of ABICyano1 and subsequent production of ethanol, pdc(opt1)-synadh(opt1), and pdc(opt3)-synadh(opt3). The pdc genes were derived from the Z. mobilis pdc and the adh genes from Synechocystis PCC 6803 adh. Optimization of the opt1 version was manually codon optimized by replacing all rare codons for one amino acid by the most frequently occurring codon for that amino acid based on ABICyano1 codon usage. The ethanologenic gene cassette opt3 was optimized using a two-step process which involved two programs (Optimizer and GENE designer DNA 2.0) which led to codon optimization similar to the codon usage of ABICyano1.

In an embodiment, and as depicted in table 4, ethanologenic plasmids derived from p6.8 and containing an ethanologenic cassette are used for the transformation of ABICyano1. Table 8 also depicts the ethanol production in transformed ABICyano1 cells. The ethanol production was measured in GC vials. These plasmids of table 4 contain various configurations of ethanologenic cassettes, having a gene encoding PDC and a gene encoding ADH. Various promoters, as listed in table 4 below, were used. Also, the genes were codon improved for expression in ABICyano1. Different origins of the genes from various organisms are also noted in table 4. Any of the ethanologenic cassettes may be present in modified organisms of the present invention.

TABLE 4

| Plasmid FIG. SEQ ID NO: | Construct | % EtOH/OD*d (measured in GC Vial) |
|---|---|---|
| pRL528 | Helper plasmid for conjugal transfer, M. AvaI, M. AvaII (Elhai & Wolk, 1988) | Used to assist in conjugation |

TABLE 4-continued

Figure 8:
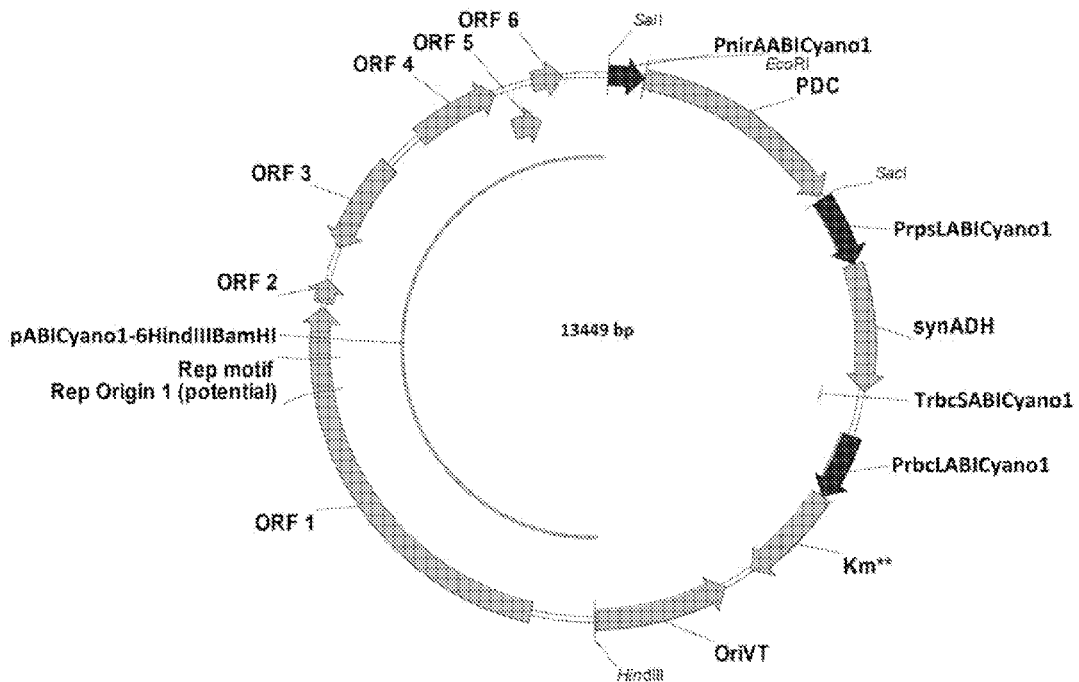
FIG. 8 depicts a map of the plasmid construct and sequence annotation of plasmid TK293 (pABICyano1-6.8 PnirAABICyano1-PDC(opt1)-PrpsLABICyano1-synADH(opt1)-PrbcABICyano1-Km**-oriVT).
Figure 9:
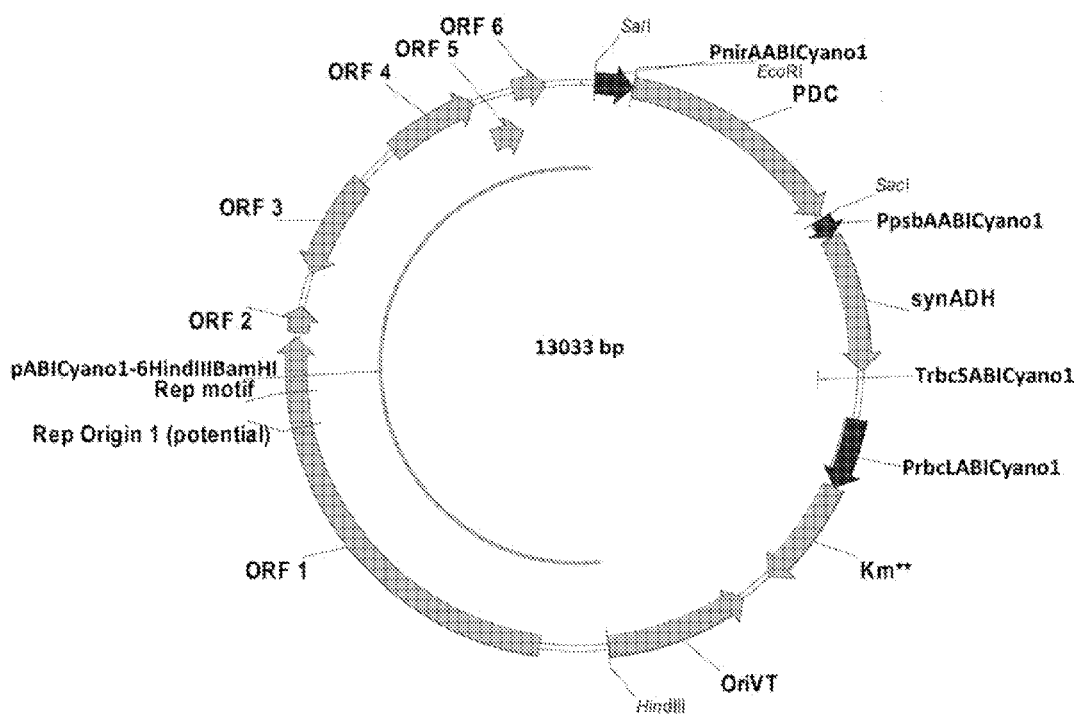
FIG. 9 is a map of the plasmid construct and sequence annotation of plasmid TK295 (pABICyano1-6.8 PnirAABICyano1-PDC(opt1)-PpsbAABICyano1-synADH(opt1)-PrbcABICyano1-Km**-oriVT).
Figure 10:
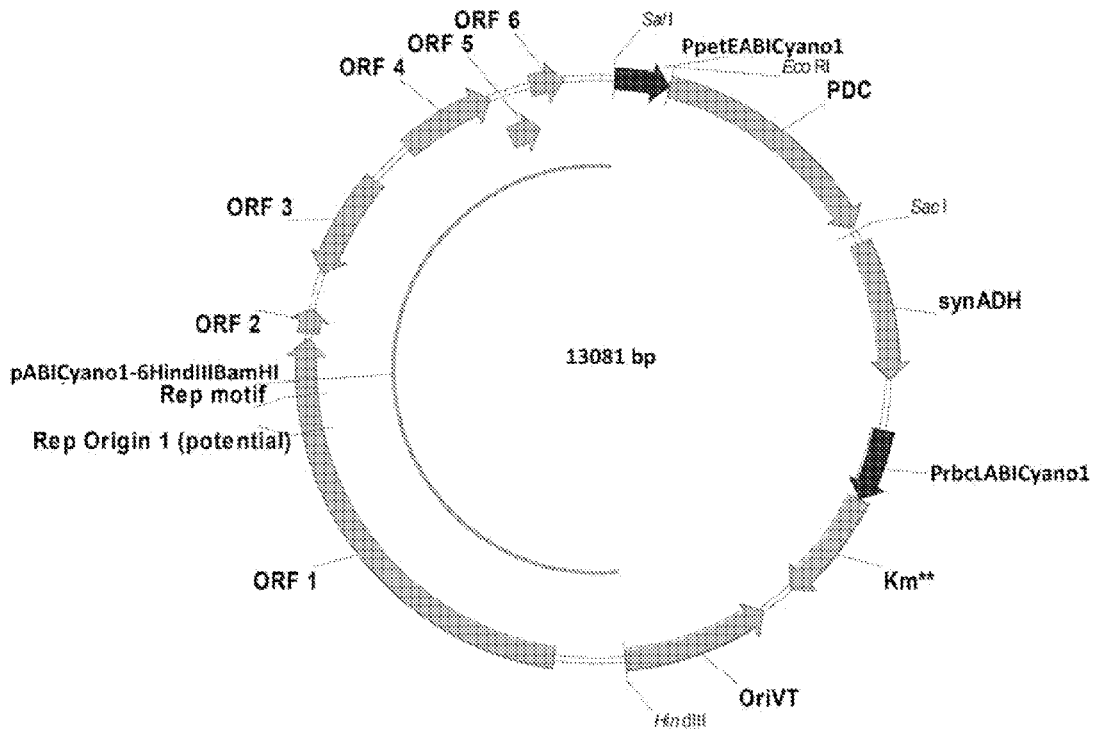
FIG. 10 is a map of the plasmid construct and sequence annotation of plasmid TK229 (pABICyano1-6.8 PpetEABICyano1-PDC(opt1)-synADH(opt1)-PrbcABICyano1-Km**-oriVT).
Figure 11:
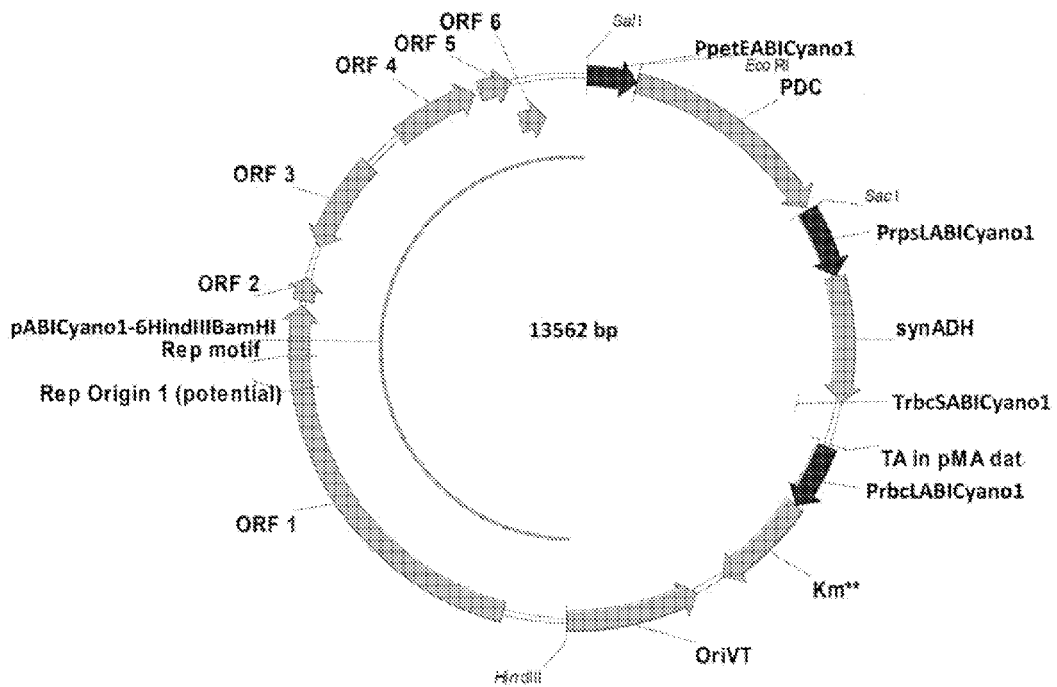
FIG. 11 depicts a map of the plasmid construct TK368 (pABICyano1-6.8 PpetEABICyano1-PDC(opt1)-PrpsLABICyano1-synADH(opt1)-PrbcABICyano1-Km**-oriVT).
Figure 12:
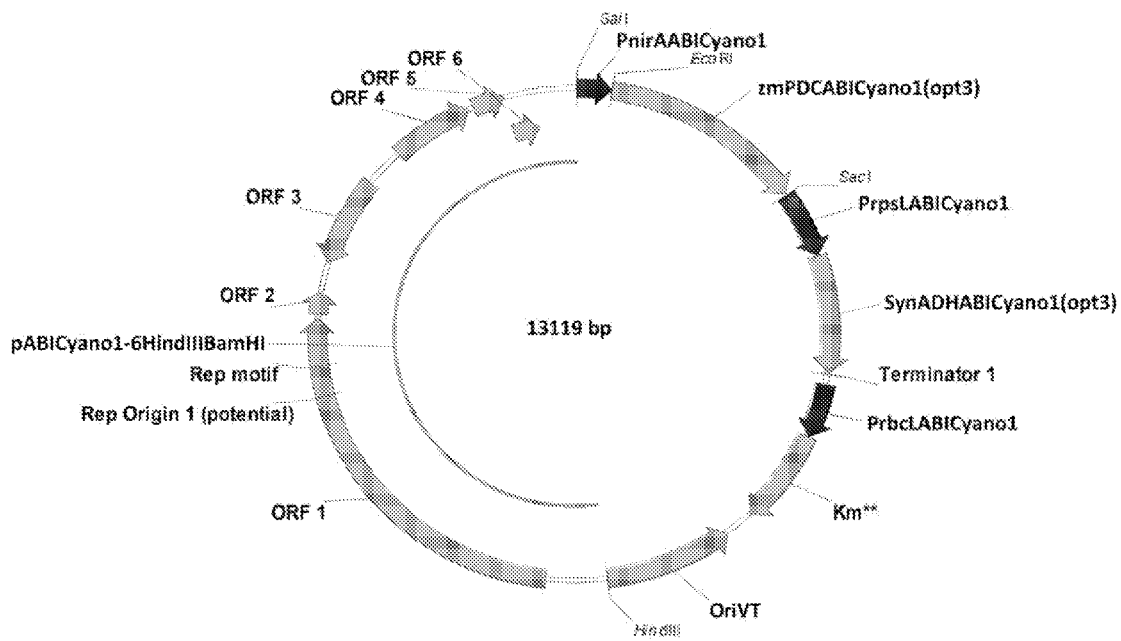
FIG. 12 depicts a map of the plasmid construct and sequence annotation of plasmid #1495 (pABICyano1-6.8::PnirAABICyano1-zmPDCABICyano1(opt3)-PrpsLABICyano1-ADHABICyano1(opt3) ter-PrbcABICyano1-Km**).
Figure 13:
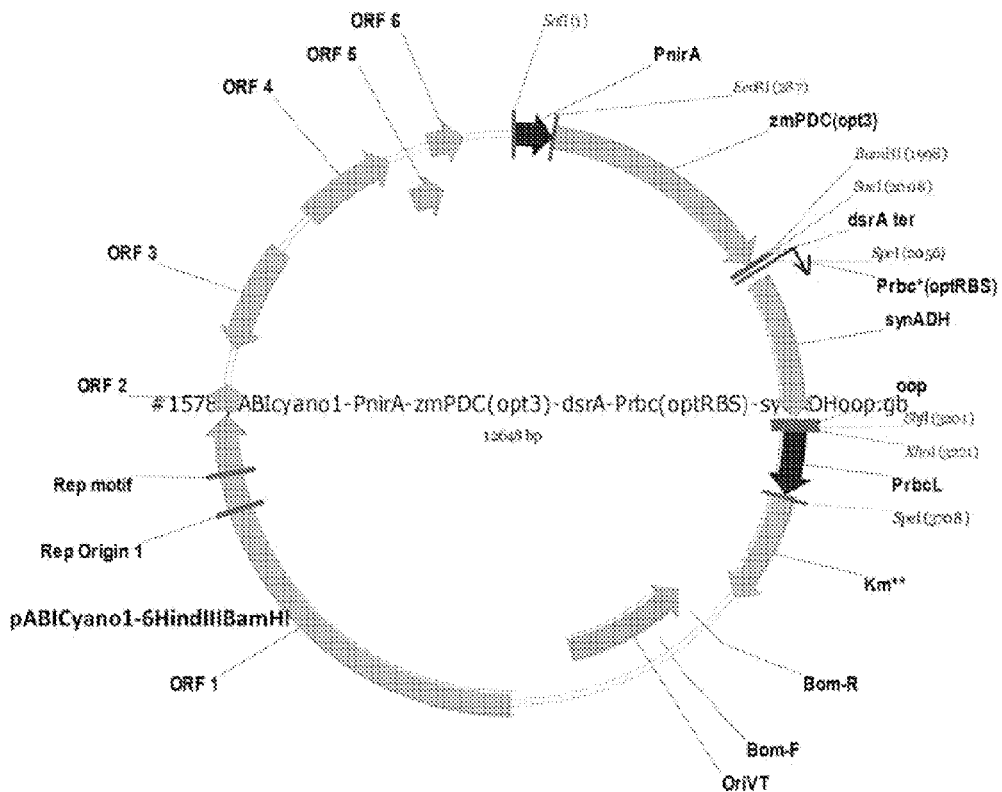
FIG. 13 depicts a map of the plasmid construct and sequence annotation of plasmid #1578 (pABIcyano1-PnirA-zmPDC(opt3)-dsrA-Prbc(optRBS)-synADHoop).
Figure 14:
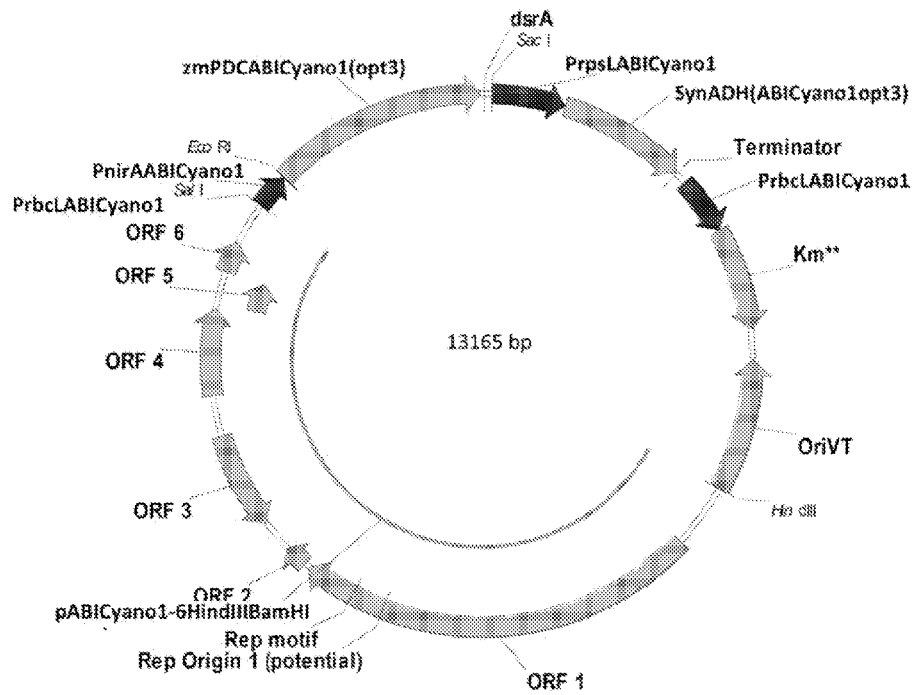
FIG. 14 depicts a map of the plasmid construct and sequence annotation of plasmid #1581 (pABICyano1-6.8::PnirAABICyano1-zmPDCABICyano1(opt3)-dsrA-PrpsLABICyano1-ADHABICyano1(opt3)ter-PrbcABICyano1-Km**).
Figure 15:
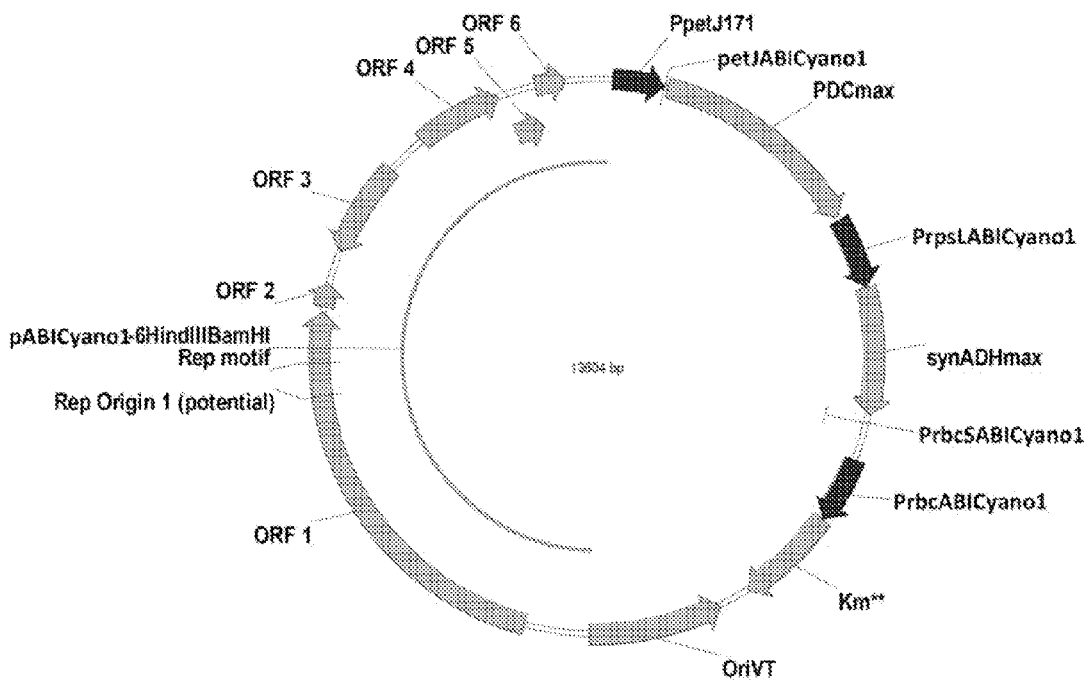
FIG. 15 depicts a map of plasmid construct and sequence annotation of plasmid TK441 (pABICyano:PpetJABICyano1-PDC(opt1)-PrpsLABICyano-synADH(opt1)-PrbcABICyano-Km**).

| Plasmid FIG. SEQ ID NO: | Construct | % EtOH/OD*d (measured in GC Vial) |
|---|---|---|
| TK225 FIG. 7 SEQ ID NO: 42 | pABICyano1-6.8::$P_{nirA}$ ABICyano1-PDC(opt1)-synADH(opt1)-$P_{rbc}$ ABICyano1-Km** | ~0.007 |
| TK293 FIG. 8 SEQ ID NO: 43 | pABICyano1-6.8::$P_{nirA}$ ABICyano1-PDC(opt1)-$P_{rpsL}$ ABICyano1-synADH(opt1)- $P_{rbc}$ ABICyano1-Km** | 0.024 |
| TK295 FIG. 9 SEQ ID NO: 44 | pABICyano1-6.8::$P_{nirA}$ ABICyano1-PDC(opt1)-$P_{psbA}$ ABICyano1-synADH(opt1)- $P_{rbc}$ ABICyano1-Km** | 0.005-0.01 |
| TK229 FIG. 10 SEQ ID NO: 45 | pABICyano1-6.8::$P_{petE}$ ABICyano1-PDC(opt1)-synADH(opt1)- $P_{rbc}$ ABICyano1-Km** | 0.002 |
| TK368 FIG. 11 SEQ ID NO: 46 | pABICyano1-6.8::$P_{petE}$ ABICyano1-PDC(opt1)- $P_{rpsL}$ ABICyano1-synADH(opt1)- $P_{rbc}$ ABICyano1-Km** | >>0.02 (not inducible but constitutive) |
| #1536 | pABICyano1-6.8::smtB-$P_{smtA}$(ABCC1535)-PDC(opt1)-$P_{rpsL}$ ABICyano1-synADH(opt1)- $P_{rbc}$ ABICyano1-Km** | ~0.006 ($Zn^{2+}$ inducible) |
| #1495 FIG. 12 SEQ ID NO: 47 | pABICyano1-6.8::$P_{nirA}$ ABICyano1-zmPDCABICyano1 (opt3)-$P_{rpsL}$ ABICyano1-ADH ABICyano1 (opt3)_ter-$P_{rbc}$ ABICyano1-Km** | 0.023 |
| #1578 FIG. 13 SEQ ID NO: 48 | pABICyano1-6.8::$P_{nirA}$ ABICyano1-zmPDC ABICyano1 (opt3)-dsrA-$P_{rbc}$*(optRBS)-synADH\oop-$P_{rbc}$ ABICyano1-Km** | 0.031 |
| #1581 FIG. 14 SEQ ID NO: 49 | pABICyano1-6.8::$P_{nirA}$ ABICyano1-zmPDC ABICyano1 (opt3)-dsrA-$P_{rpsL}$ ABICyano1-ADH ABICyano1 (opt3)_ter-$P_{rbc}$ ABICyano1-Km** | 0.030 |
| TK441 FIG. 15 SEQ ID NO: 50 | pABICyano1-6.8::$P_{petJ}$ ABICyano1-PDCopt1-$P_{rpsL}$ ABICyano1-synADHopt1-$P_{rbc}$ ABICyano1-Km**-oriVT | 0.017 |

Figure 16:
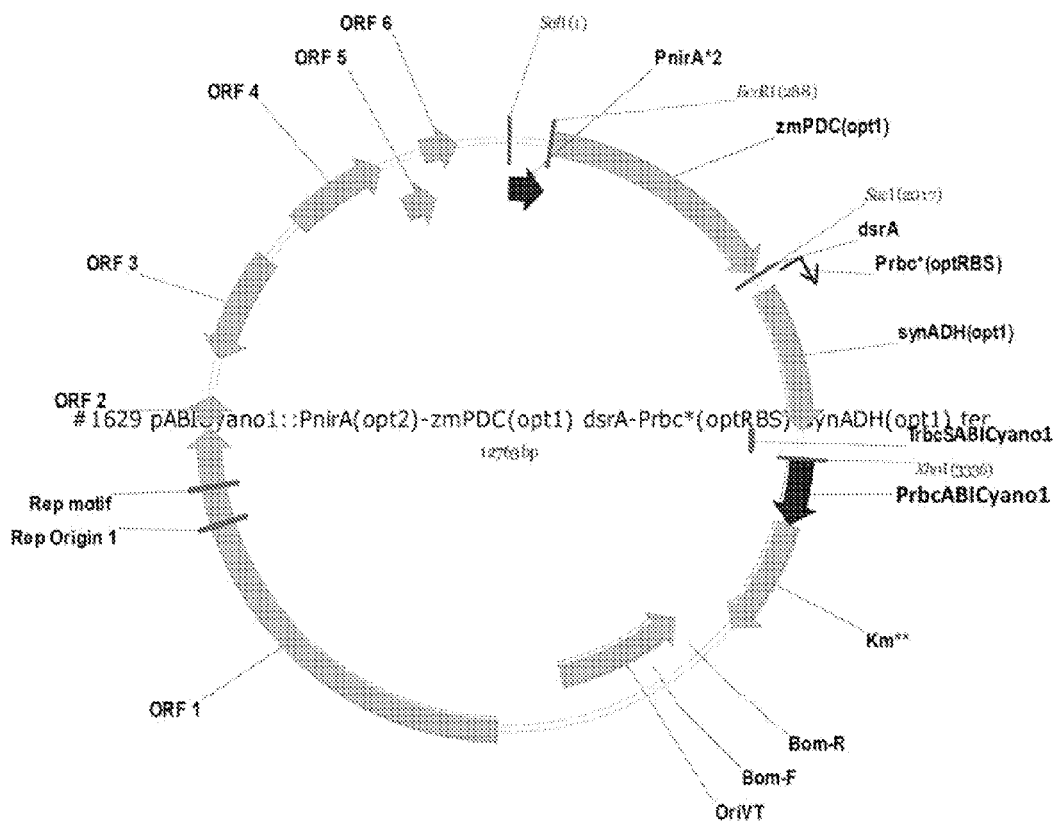
FIG. 16 depicts a map of plasmid construct and sequence annotation of plasmid #1629 (pABICyano1-6.8::PnirA(opt2)-zmPDC(opt1)_dsrA-Prbc*(optRBS)-synADH(opt1)_ter).

FIG. 16 depicts a map of the plasmid construct #1629 (pABICyano1-6.8::PnirA(opt2)-zmPDC(opt1)_dsrA-Prbc*(optRBS)-synADH(opt1)_ter) (SEQ ID NO: 51) including the endogenous nirA promoter from ABICyano1 with an improved ribosomal binding site (nucleotides 1 to 287 of SEQ ID NO: 51) in comparison to the respective native promoter. This modified promoter controls the transcription of a pdc gene, which can be codon improved.

Figure 17:
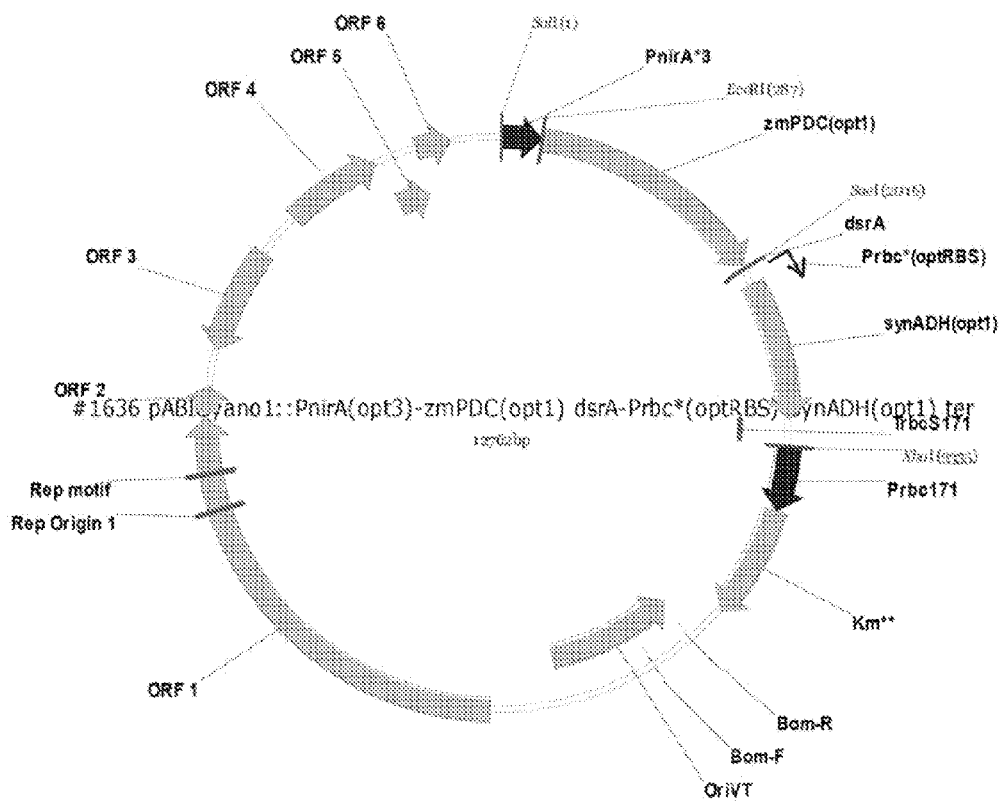
FIG. 17 depicts a map of plasmid construct and sequence annotation of plasmid #1636 (pABICyano1-6.8::PnirA(opt3)-zmPDC(opt1)_dsrA-Prbc*(optRBS)-synADH(opt1)_ter).

FIG. 17 depicts a map of the plasmid construct #1636 (pABICyano1-6.8::PnirA*3-zmPDC(opt1)_dsrA-Prbc*(optRBS)-synADH(opt1)_ter) (SEQ ID NO: 52) including the endogenous nirA promoter from ABICyano1 with an improved binding site for the regulators NtcA and NtcB and an improved TATA box (nucleotides 6 to 283 of SEQ ID NO: 52) in comparison to the respective native promoter. This modified promoter controls the transcription of a pdc gene, which can be codon improved.

Figure 18:
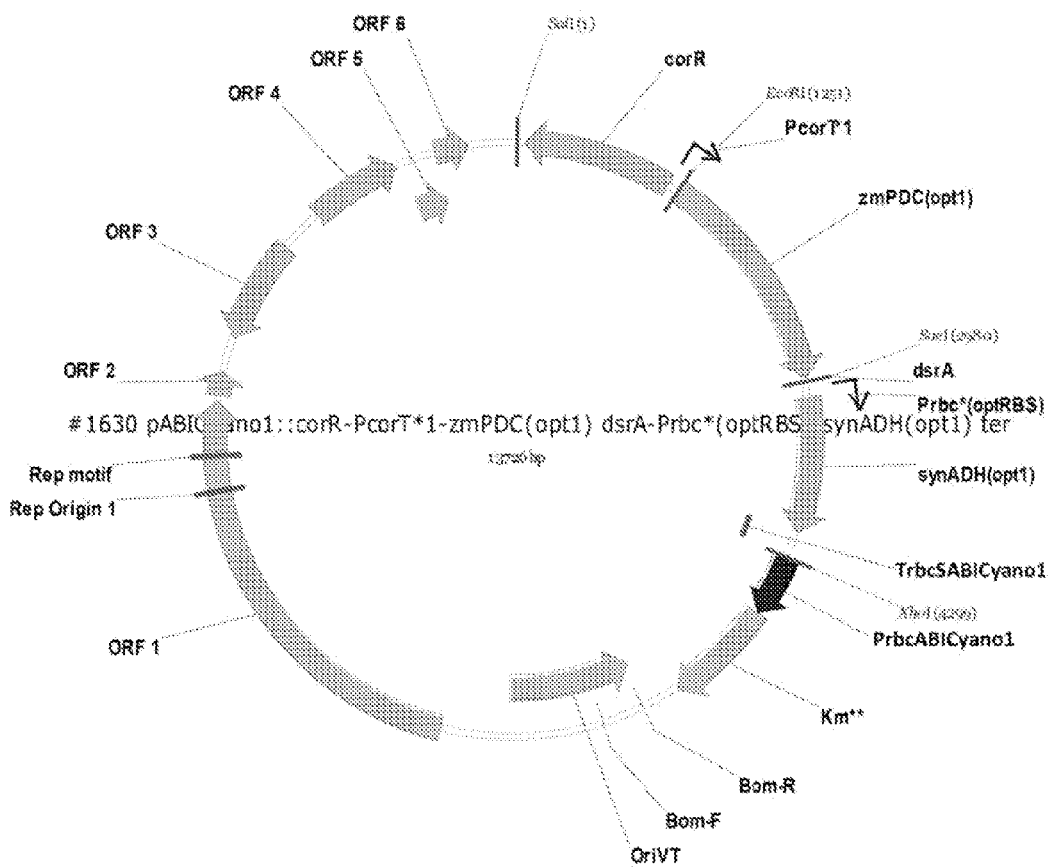
FIG. 18 depicts a map of plasmid construct and sequence annotation of plasmid #1630 (pABICyano1-6.8::corR-PcorT*1-zmPDC(opt1)_dsrA-Prbc*(optRBS)-synADH(opt1)_ter).

FIG. 18 depicts a map of the plasmid construct #1630 (pABICyano1-6.8::corR-PcorT*1-zmPDC(opt1)_dsrA-Prbc*(optRBS)-synADH(opt1)_ter) (SEQ ID NO: 53) including the endogenous corT promoter from Synechocystis PCC 6803 with an improved ribosomal binding site (nucleotides 1168 to 1247 of SEQ ID NO: 53) in comparison to the respective native promoter. This modified promoter controls the transcription of a pdc gene, which can be codon improved.

Figure 19:
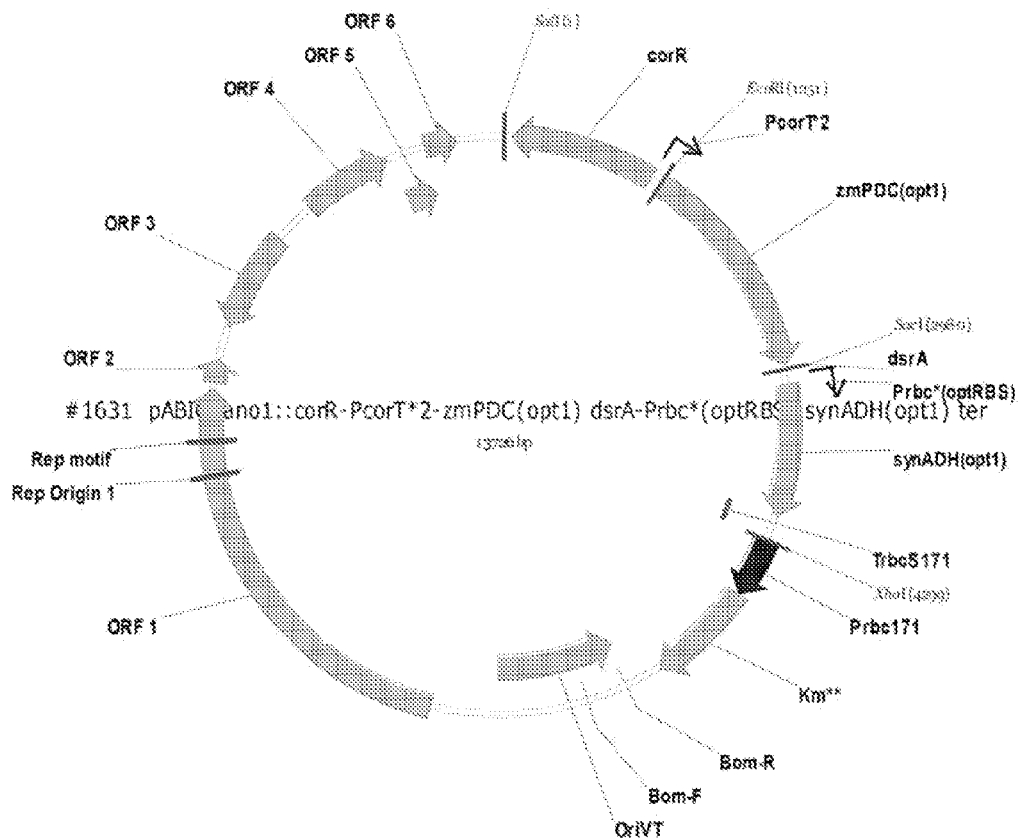
FIG. 19 depicts a map of plasmid construct and sequence annotation of plasmid #1631 (pABICyano1-6.8::corR-PcorT*2-zmPDC(opt1)_dsrA-Prbc*(optRBS)-synADH(opt1)_ter).

FIG. 19 depicts a map of the plasmid construct #1631 (pABICyano1-6.8::corR-PcorT*2-zmPDC(opt1)_dsrA-Prbc*(optRBS)-synADH(opt1)_ter) (SEQ ID NO: 54)

including the endogenous corT promoter from *Synechocystis* PCC6803 with an improved TATA box (nucleotides 1169 to 1247 of SEQ ID NO: 54) in comparison to the respective native promoter. This modified promoter controls the transcription of a pdc gene, which can be codon improved.

Figure 20:
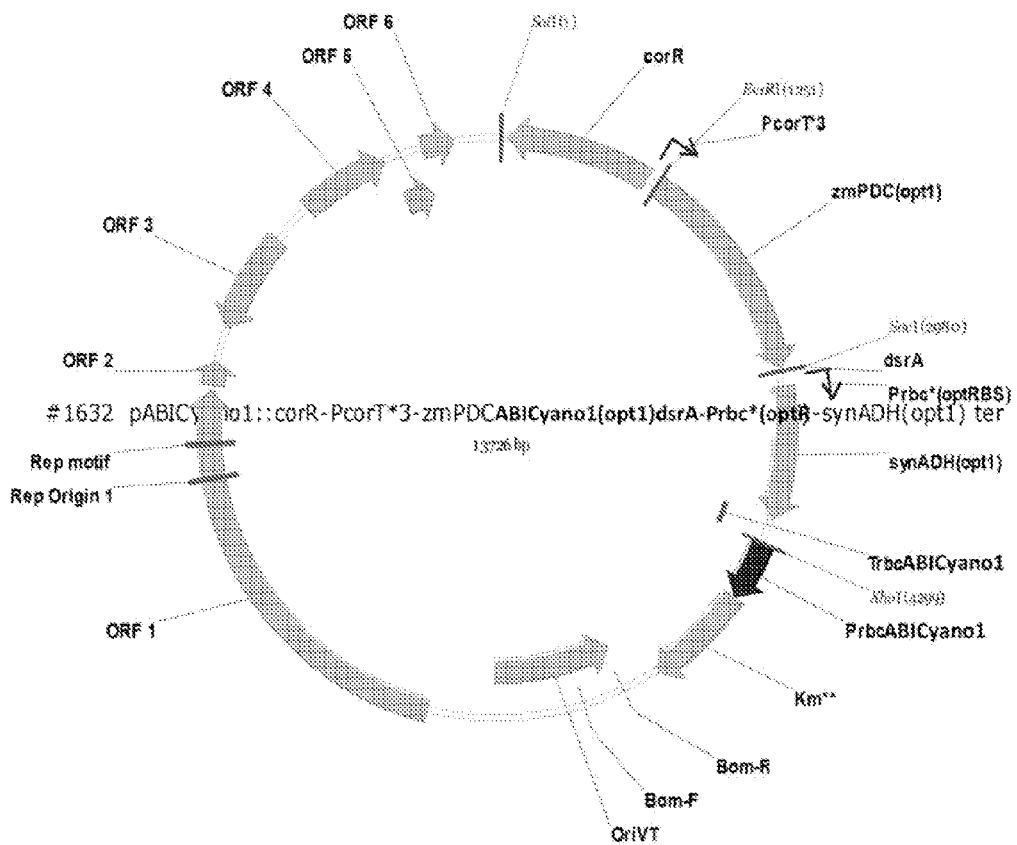
FIG. 20 depicts a map of plasmid construct and sequence annotation of plasmid #1632 (pABICyano1-6.8::corR-PcorT*3-zmPDCABICyano1(opt1)_dsrA-Prbc*(optRBS)-synADH(opt1)_ter).
Figure 37:
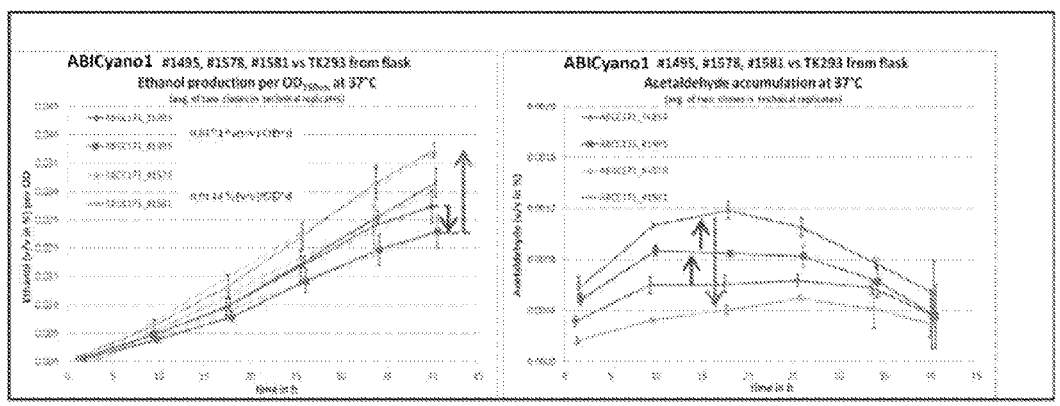
FIG. 37 depicts the ethanol production rates and the acetaldehyde accumulation for *Cyanobacterium* sp. ABICyano1 strains TK293, #1495, #1578 and #1581.

FIG. 20 depicts a map of the plasmid construct #1632 (pABICyano1-6.8::corR-PcorT*3-zmPDCABICyano1 (opt1)_dsrA-Prbc*(optRBS)-synADH(opt1)_ter) (SEQ ID NO: 55) including the endogenous corT promoter from *Synechocystis* PCC6803 with an improved TATA box and ribosomal binding site (nucleotides 1169 to 1247 of SEQ ID NO: 55) in comparison to the respective native promoter. This modified promoter controls the transcription of a pdc gene, which can be codon improved. The nucleotide sequence of the plasmid is depicted in FIG. 37 including the annotation of the genes and promoters done with the program vector NTI.

Figure 21:
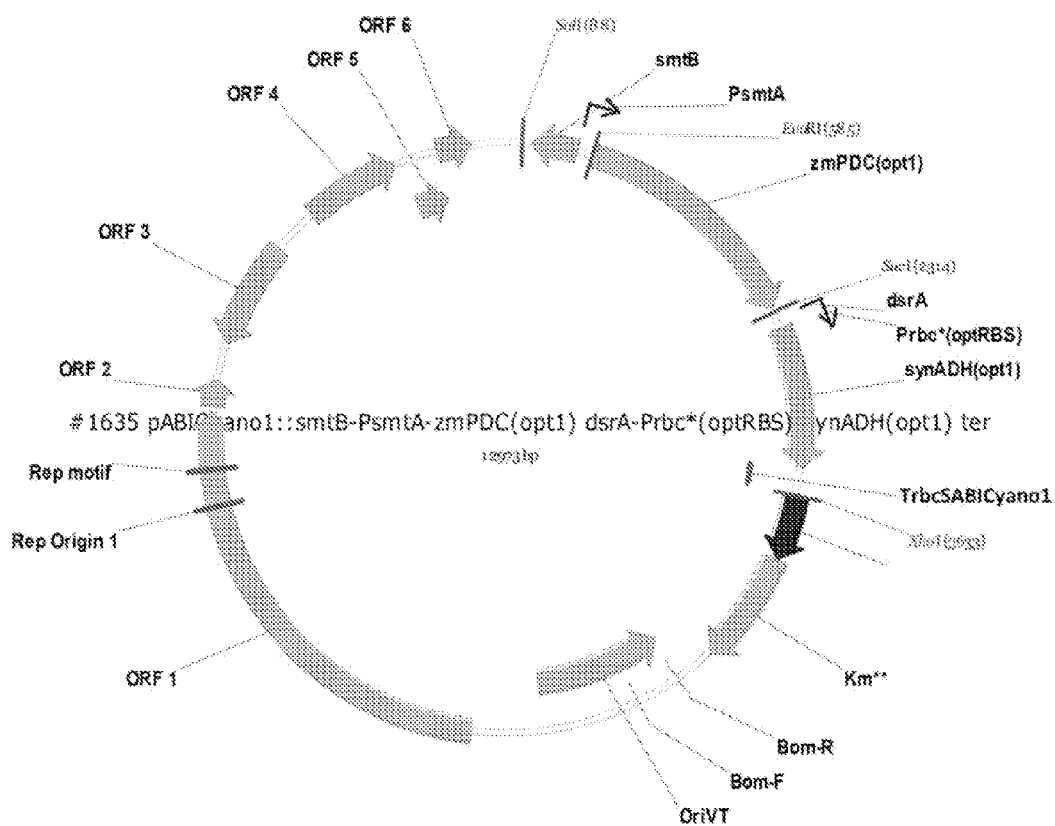
FIG. 21 depicts a map of plasmid construct and sequence annotation of plasmid #1635 (pABICyano1-6.8::smtB-PsmtA-zmPDC(opt1)_dsrA-Prbc*(optRBS)-synADH(opt1)_ter).

FIG. 21 depicts a map of the plasmid construct #1635 (pABICyano1-6.8::smtB-PsmtA*2-zmPDC(opt1)_dsrA-Prbc*(optRBS)-synADH(opt1)_ter) (SEQ ID NO: 56) including the native smtA promoter from *Synechococcus* PCC7002 (nucleotides 480 to 581 of SEQ ID NO: 56). This promoter controls the transcription of a pdc gene, which can be codon improved.

Figure 22:
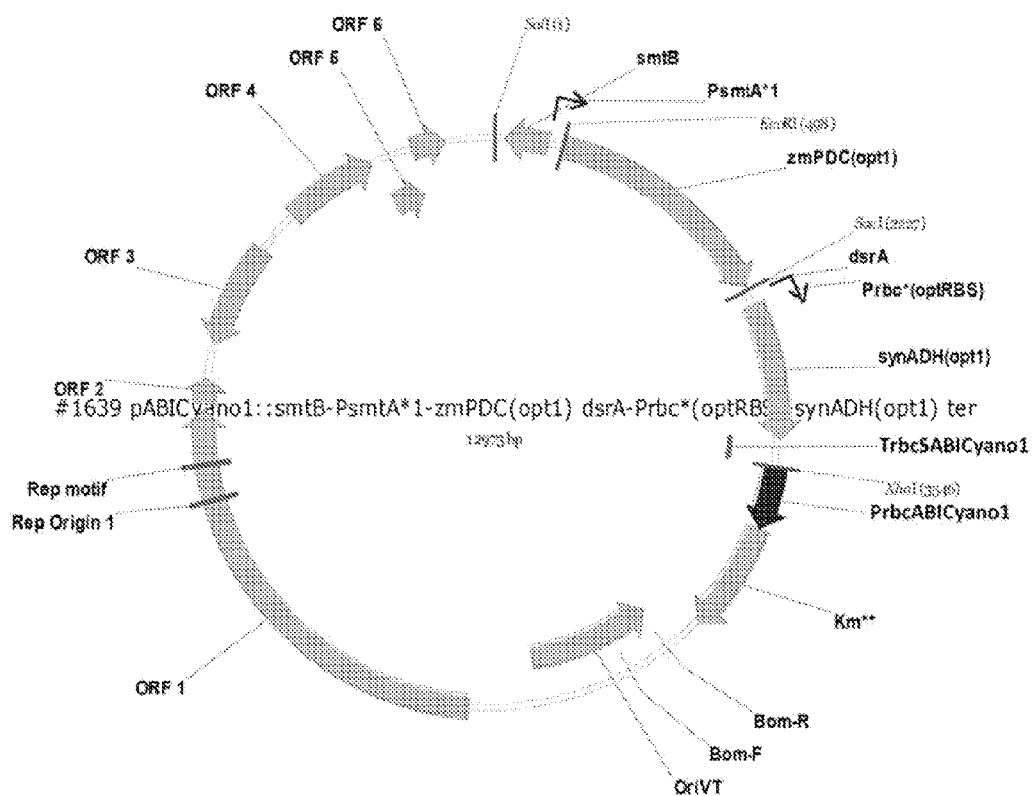
FIG. 22 depicts a map of plasmid construct and sequence annotation of plasmid #1639 (pABICyano1-6.8::smtB-PsmtA*1-zmPDC(opt1)_dsrA-Prbc*(optRBS)-synADH(opt1)_ter).

FIG. 22 depicts a map of the plasmid construct #1639 (pABICyano1-6.8::smtB-PsmtA*1-zmPDC(opt1)_dsrA-Prbc*(optRBS)-synADH(opt1)_ter) (SEQ ID NO: 57) including a modified smtA promoter from *Synechococcus* PCC7002 which includes a modified RBS (nucleotides 394 to 494 of SEQ ID NO: 57) in comparison to the native promoter. This modified promoter controls the transcription of a pdc gene, which can be codon improved.

Figure 23:
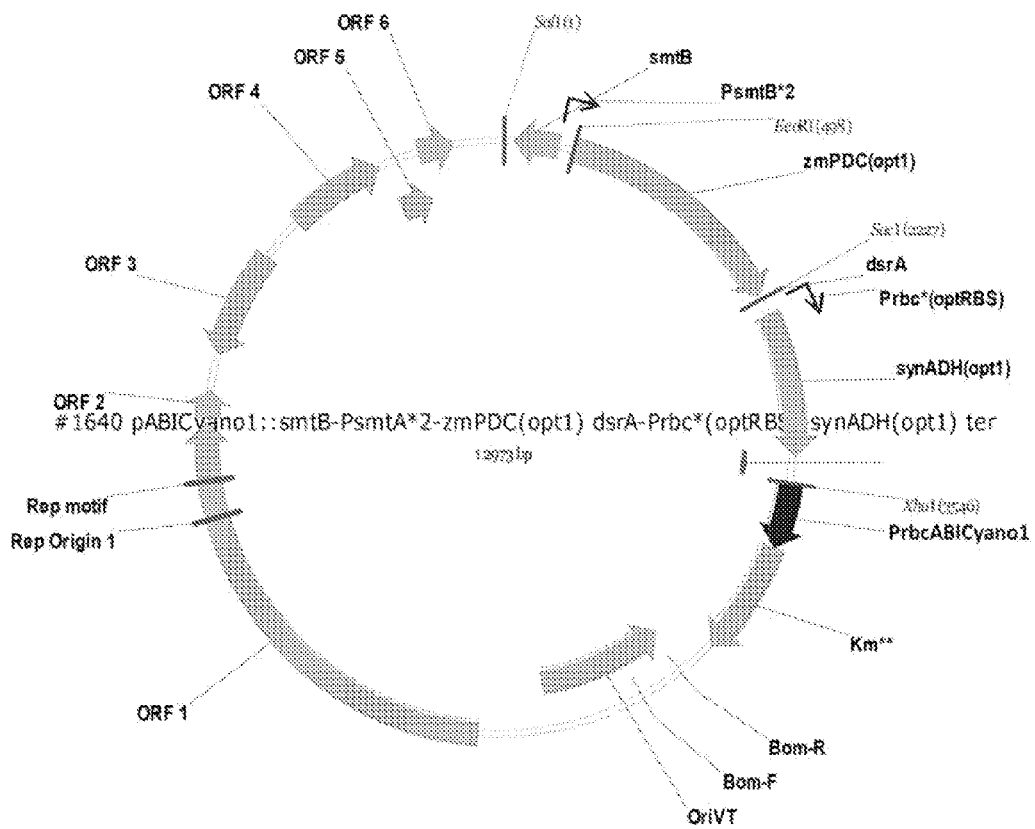
FIG. 23 depicts a map of plasmid construct and sequence annotation of plasmid #1640 (pABICyano1-6.8::smtB-PsmtA*2-zmPDC(opt1)_dsrA-Prbc*(optRBS)-synADH(opt1)_ter).

FIG. 23 depicts a map of the plasmid construct #1640 (pABICyano1-6.8::smtB-PsmtA*2-zmPDC(opt1)_dsrA-Prbc*(optRBS)-synADH(opt1)_ter) (SEQ ID NO: 58) including a modified smtA promoter from *Synechococcus* PCC7002 which includes another modified RBS (nucleotides 393 to 494 of SEQ ID NO: 58) in comparison to the native promoter. This modified promoter controls the transcription of a pdc gene, which can be codon improved.

Figure 24:
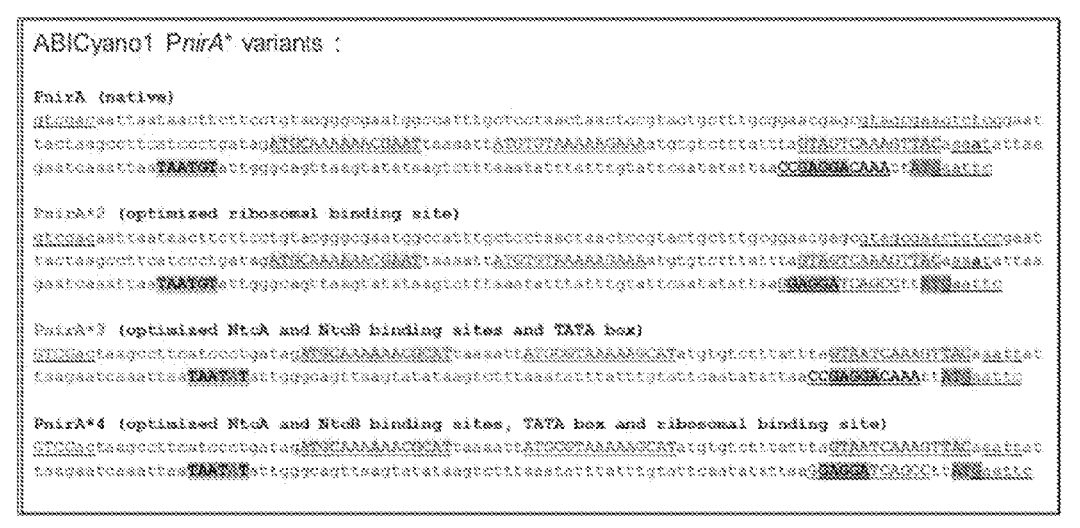

FIG. 24 depicts a sequence comparison between the native promoter nirA from ABICyano1 and different variants of the promoter harboring nucleotide changes in the ribosomal binding site, the binding sites for the regulators NtcA and NtcB and the TATA box. These promoters are included in the plasmids #1606 (pABICyano1::PnirA-zmPDC(opt1)_dsrA-Prbc*(optRBS)-synADH(opt1)_ter) (FIG. 25) (SEQ ID NO: 59), #1629 and #1636.

Figure 25:
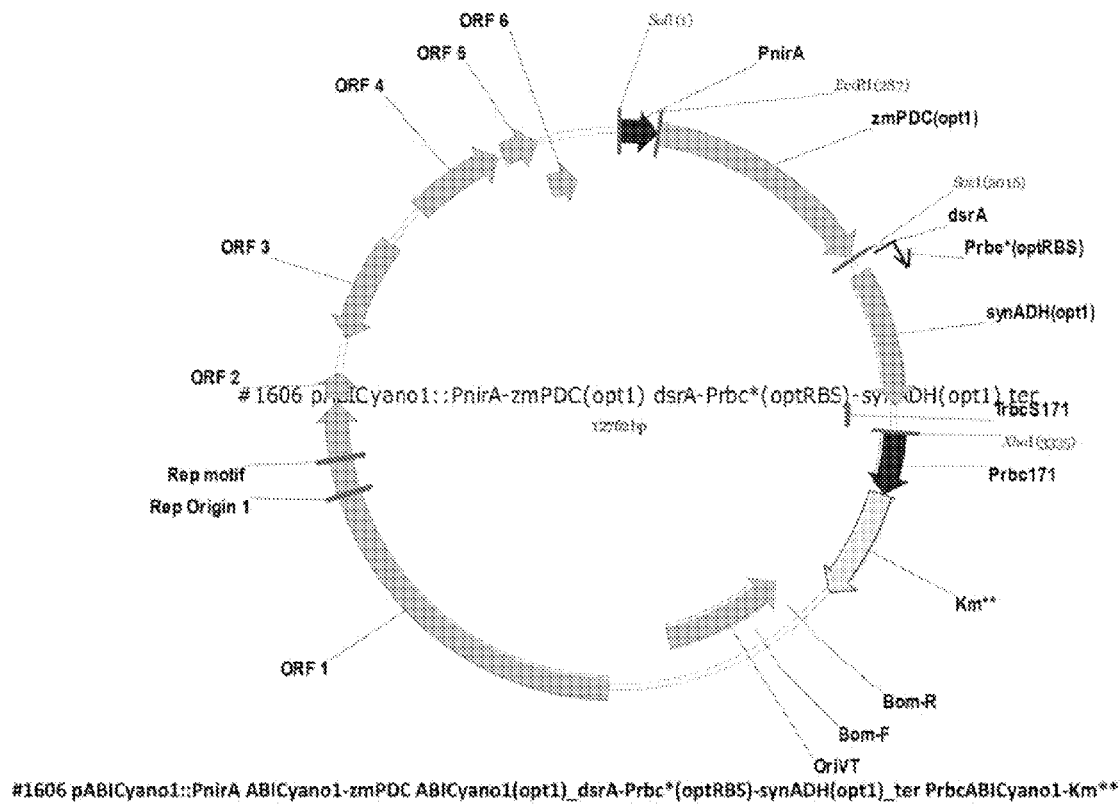
FIG. 25 depicts a map of the plasmid construct and sequence annotation of plasmid #1606 (pABICyano1::PnirA-zmPDC(opt1)_dsrA-Prbc*(optRBS)-synADH(opt1)_ter).

FIG. 25 depicts a map of the plasmid construct #1606 (pABICyano1-6.8::PnirA-zmPDC(opt1)_dsrA-Prbc*(optRBS)-synADH(opt1)_ter) (SEQ ID NO: 51) including the endogenous nirA promoter from ABICyano1 (nucleotides 1 to 287 of SEQ ID NO: 51). This promoter controls the transcription of a pdc gene, which, in an embodiment, can be codon improved.

Figure 26:
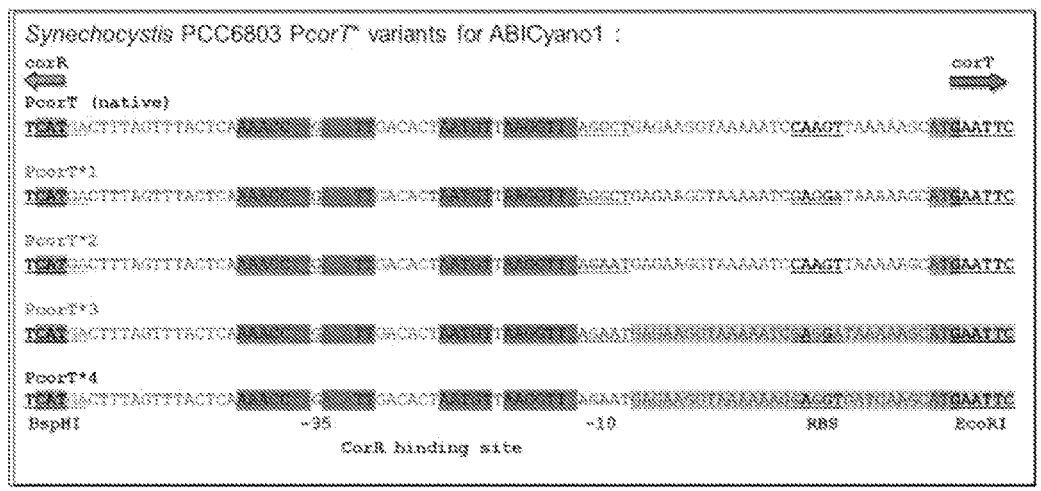
FIG. 26 depicts a nucleotide sequence comparison between different corT promoters, including native corT from Synechocystis PCC 6803 (SEQ ID NO: 139), PcorT*1 (SEQ ID NO: 140), PcorT*2 (SEQ ID NO: 141), PcorT*3 (SEQ ID NO: 142), and PcorT*4 (SEQ ID NO: 143).

FIG. 26 depicts a nucleotide sequence comparison between different corT promoters including the native promoter from *Synechocystis* PCC 6803 and variants containing nucleotide changes in the TATA box, ribosomal binding site and the binding sites for the regulator corR is also depicted in FIG. 26. The promoters depicted in FIG. 26 (PcorT native (SEQ ID NO: 139), PcorT*2 (SEQ ID NO: 140), PcorT*3 (SEQ ID NO: 141), PcorT*4 (SEQ ID NO: 142)) are part of plasmids #1630, #1631 and #1632.

Figure 27:
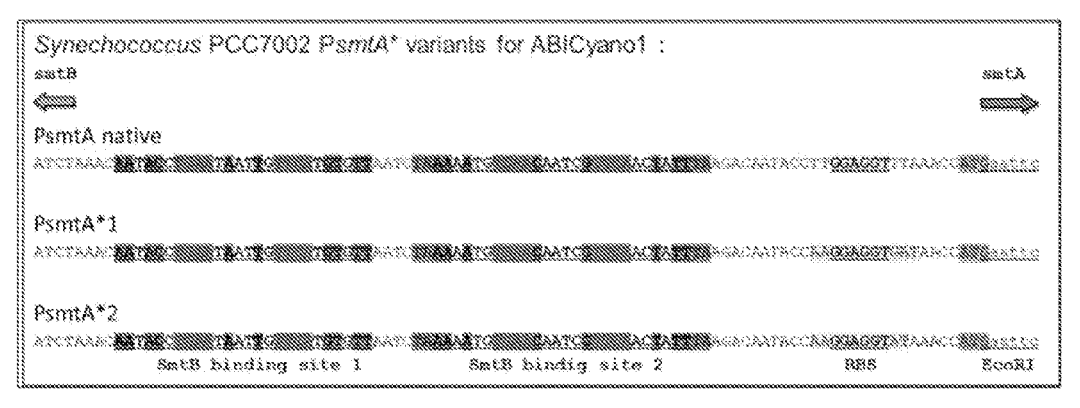

FIG. 27 depicts a nucleotide sequence comparison between the native smtA promoter from *Synechococcus* PCC 7002 and two different variants of the promoter containing mutations in the ribosomal binding site. These promoters are part of plasmids #1635, #1639 and #1640.

Figure 28:
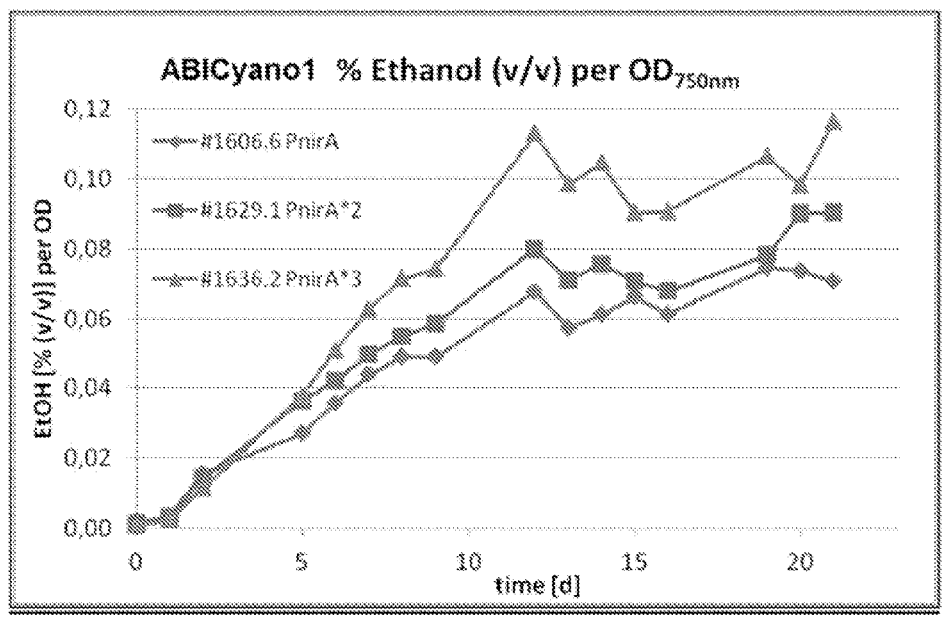
FIG. 28 depicts ethanol production normalized to the growth ($OD_{750\ nm}$) for ABICyano1 strains transformed with plasmids #1606, #1629 and #1636.

FIG. 28 depicts the ethanol production normalized to the growth ($OD_{750nm}$) determined by the CG vial method for ABICyano1 strains transformed with the plasmids #1606, plasmid #1629 and plasmid #1636 cultivated in 0.5 L PBRs for a period of time of at least 20 days.

Figure 29:
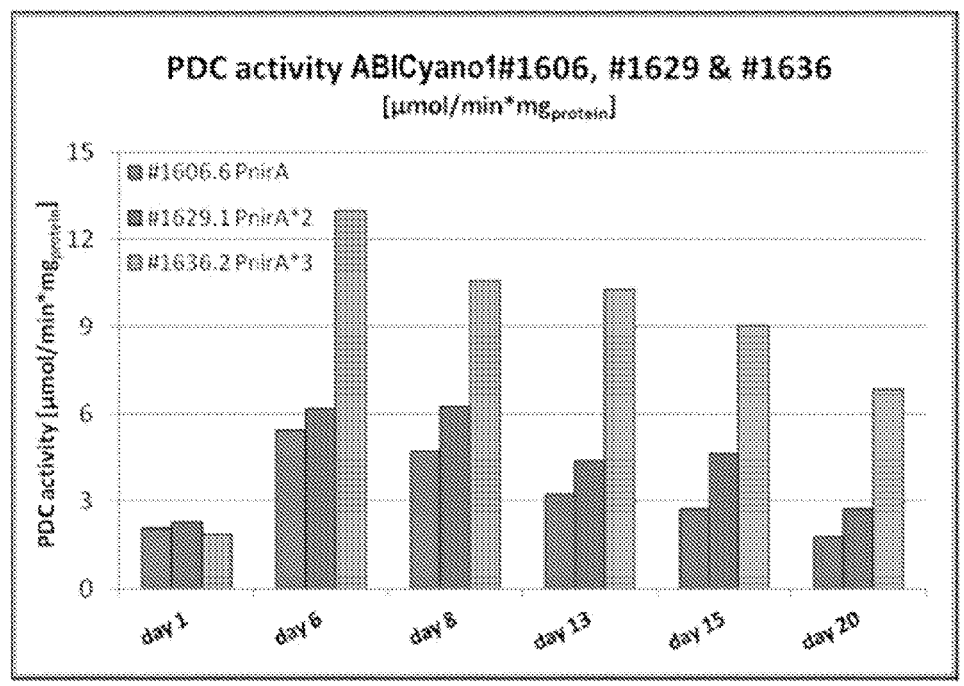
FIG. 29 depicts the specific activity of PDC for ABICyano1 strains transformed with plasmids #1606, #1629 and #1636.

FIG. 29 depicts the specific activity of PDC determined by the CG vial method for ABICyano1 strains transformed with the plasmids #1606, plasmid #1629 and plasmid #1636 for a period of time of about 20 days.

Figure 30:
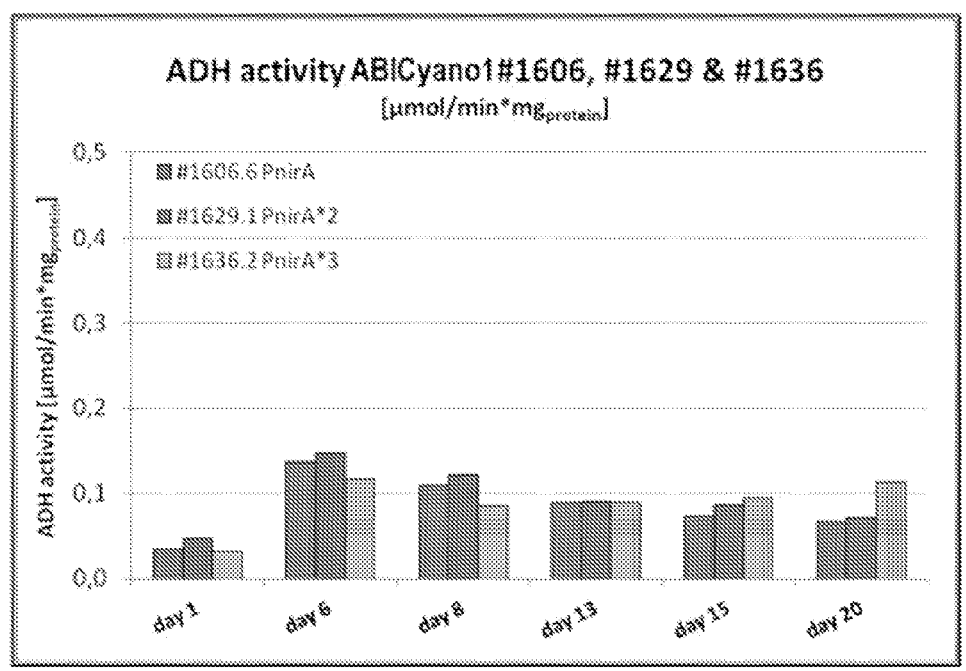
FIG. 30 depicts the specific activity of ADH for ABICyano1 strains transformed with plasmids #1606, #1629 and #1636.

FIG. 30 depicts the specific activity of ADH determined by the CG vial method for ABICyano1 strains transformed with the plasmids #1606, plasmid #1629 and plasmid #1636 cultivated in 0.5 L PBRs for a period of time of about 20 days.

Figure 31:
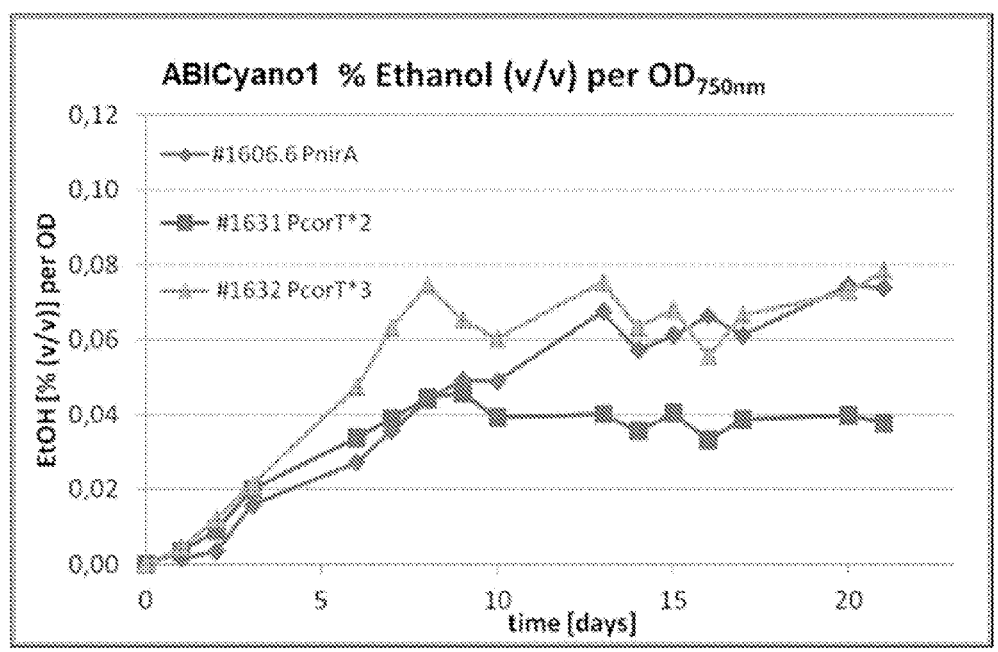
FIG. 31 depicts ethanol production normalized to the growth ($OD_{750\ nm}$) for ABICyano1 strains transformed with plasmids #1606, #1631 and #1632.

FIG. 31 depicts the ethanol production normalized to the growth ($OD_{750nm}$) determined by the CG vial method for ABICyano1 strains transformed with the plasmids plasmids #1606, plasmid #1631 and plasmid #1632 cultivated in 0.5 L PBRs for a period of time of at least 20 days.

Figure 32:
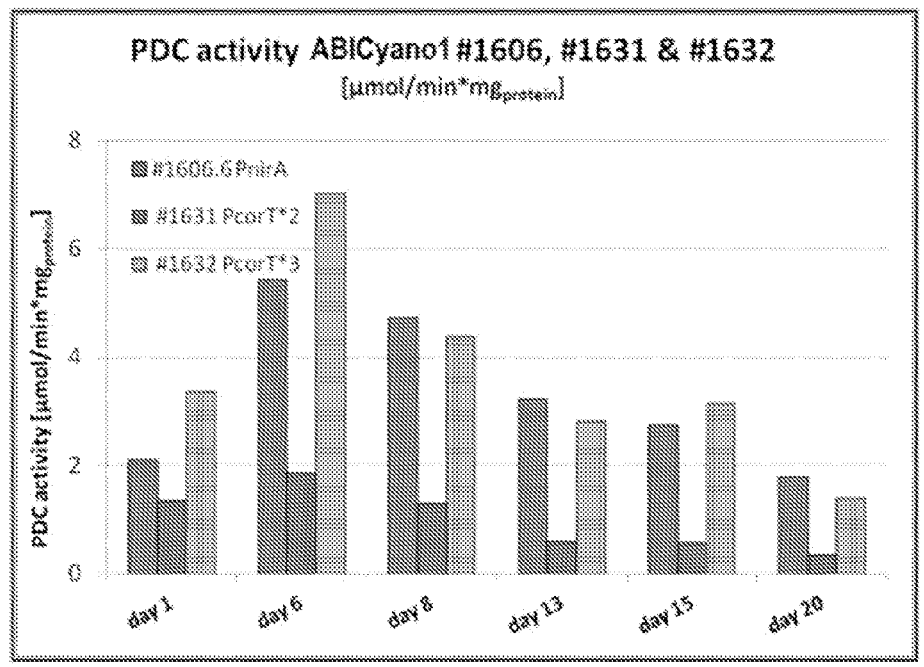
FIG. 32 depicts the specific activity of PDC for ABICyano1 strains transformed with plasmids #1606, #1631 and #1632.

FIG. 32 depicts the specific activity of PDC determined by the CG vial method for ABICyano1 strains transformed with the plasmids #1606, plasmid #1631 and plasmic #1632 cultivated in 0.5 L PBRs for a period of time of at least 20 days.

Figure 33:
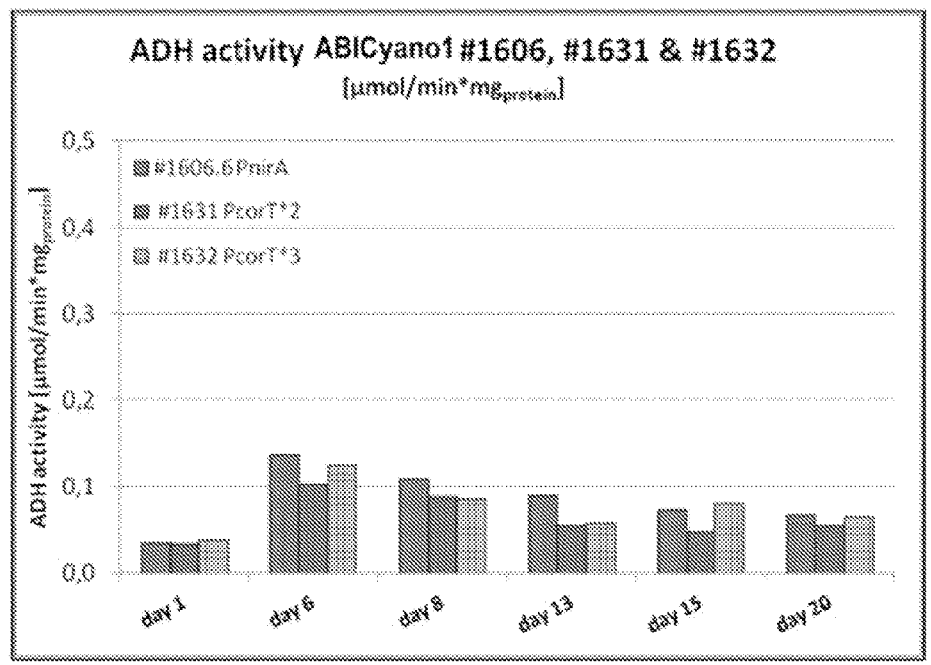
FIG. 33 depicts the specific activity of ADH for ABICyano1 strains transformed with plasmids #1606, #1631 and #1632.

FIG. 33 depicts the specific activity of ADH determined by the CG vial method for ABICyano1 strains transformed with the plasmids #1606, plasmid #1631 and plasmid #1632 cultivated in 0.5 L PBRs for a period of time of at least 20 days.

Figure 34:
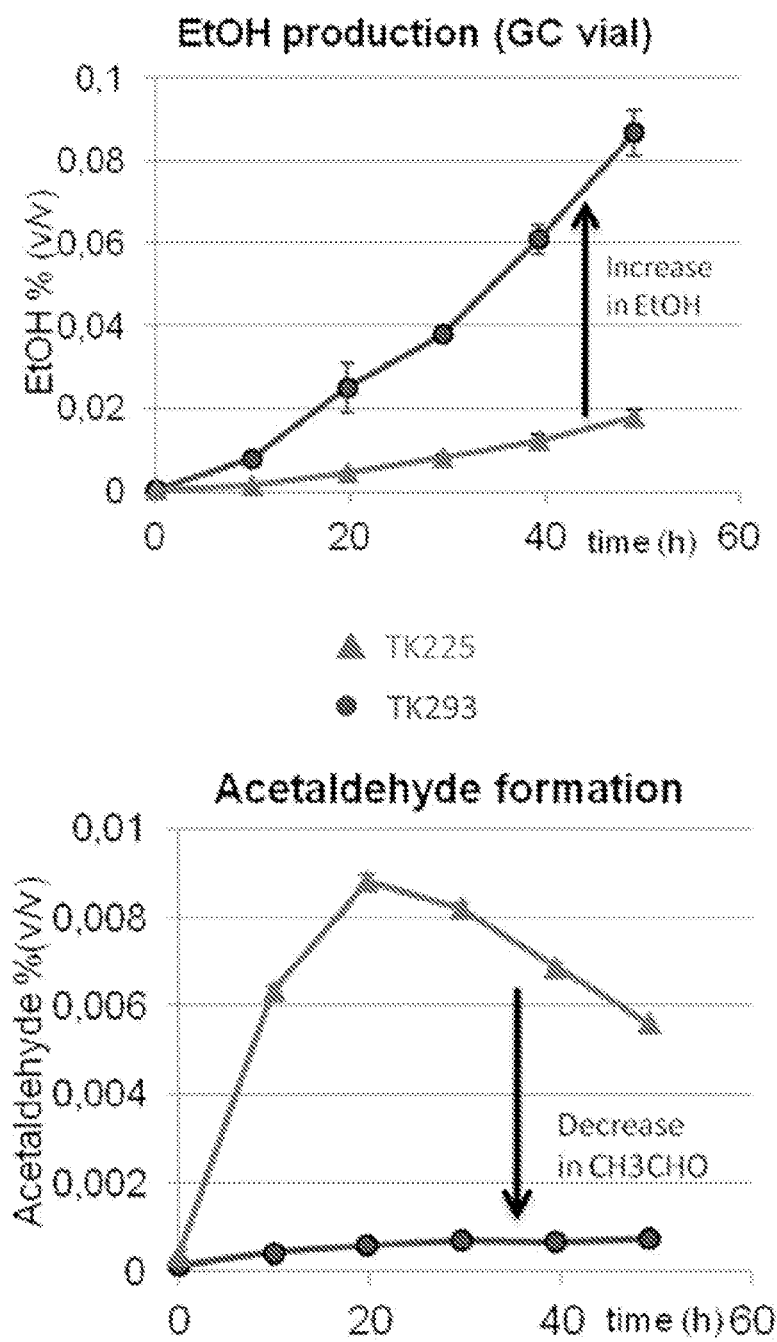
FIG. 34 depicts the production of ethanol and acetaldehyde from *Cyanobacterium* sp. ABICyano1 strains containing either one of ethanologenic plasmids TK293 and TK225.
Figures 35A, 35B, 35C, 35D:
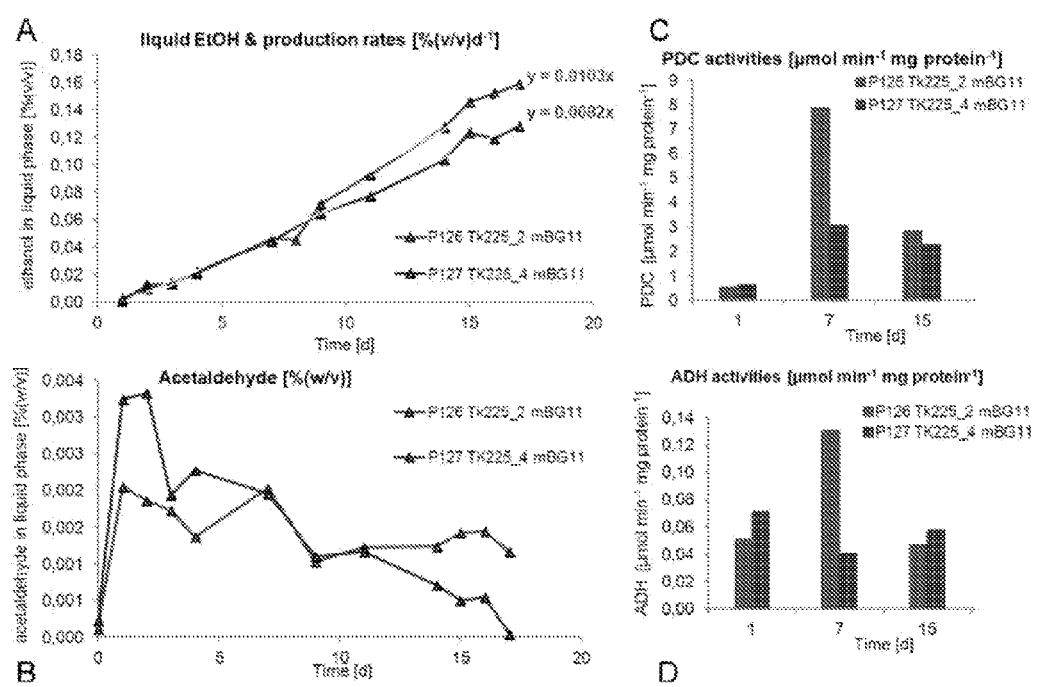
FIGS. 35A to 35D depict the ethanol production rate, acetaldehyde accumulation and ADH and PDC activities of about a 15 day cultivation of *Cyanobacterium* sp. ABICyano1 containing the ethanologenic plasmid TK225.

FIG. 34 depicts the production of ethanol and acetaldehyde determined by the GC vial assay method from *Cyanobacterium* sp. ABICyano1 strains containing either one of ethanologenic plasmids TK293 and TK225.

FIGS. 35A to 35D depict the ethanol production rate, acetaldehyde accumulation and ADH and PDC activities of about a 15 day cultivation of *Cyanobacterium* sp. ABICyano1 containing the ethanologenic plasmid TK225. Panel A depicts ethanol production (percent ethanol per volume per day) panel B depicts acetaldehyde (percent w/v), panel C depicts PDC enzyme activity over time, and panel D depicts ADH enzyme activity over time.

Figure 36A:
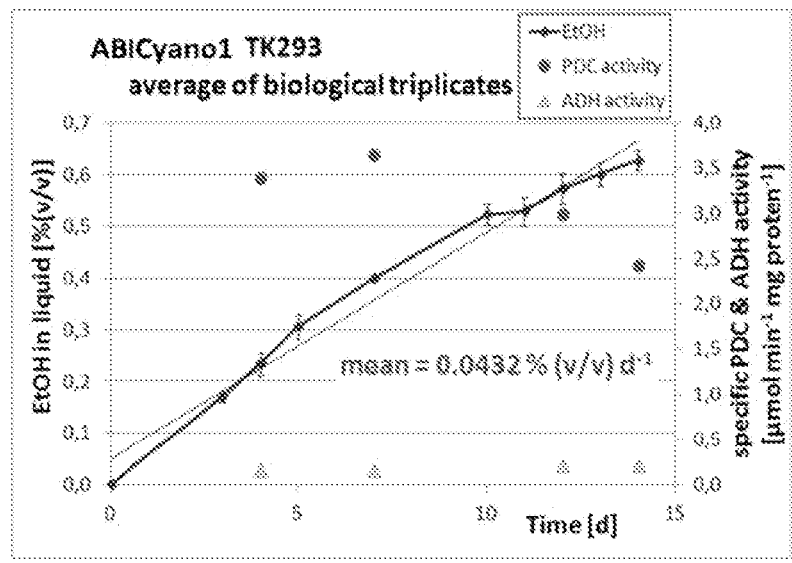
FIGS. 36A to 36C depict ethanol production rate, cell growth and maximum ethanol production rate for 7 days from a 14 day cultivation of *Cyanobacterium* sp. ABICyano1 containing the ethanologenic plasmid TK293.
Figure 36B:
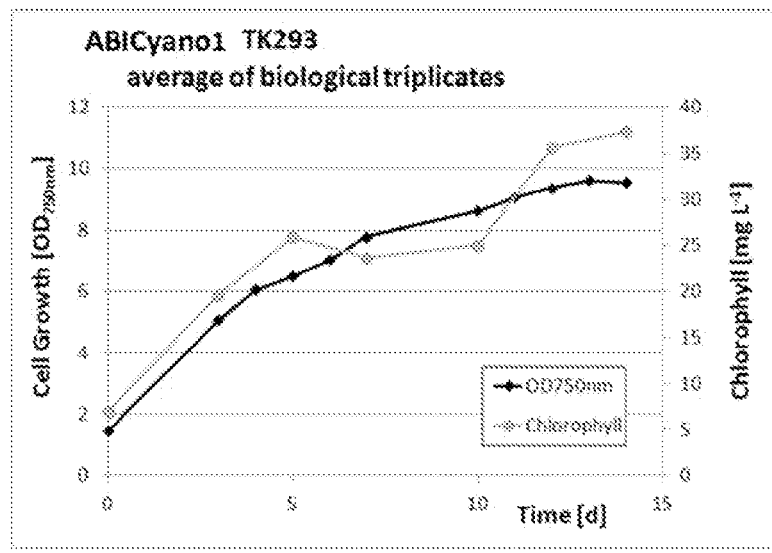
Figure 36C:
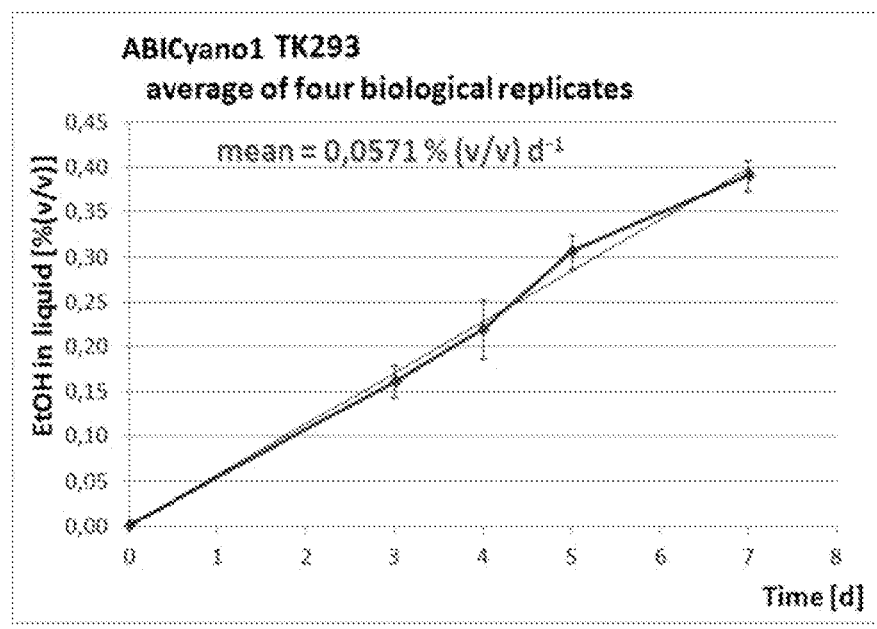

FIGS. 36A to 36C depict ethanol production rate, cell growth and maximum ethanol production rate for 7 days from a 14 day cultivation of *Cyanobacterium* sp. ABICyano1 containing the ethanologenic plasmid TK293.

FIG. 37 depicts the ethanol production rates and the acetaldehyde accumulation determined by the GC vial method for *Cyanobacterium* sp. ABICyano1 strains variously containing different ethanologenic plasmids TK293, #1495, #1578 and #1581 that were cultivated for 40 hours.

Figure 38:
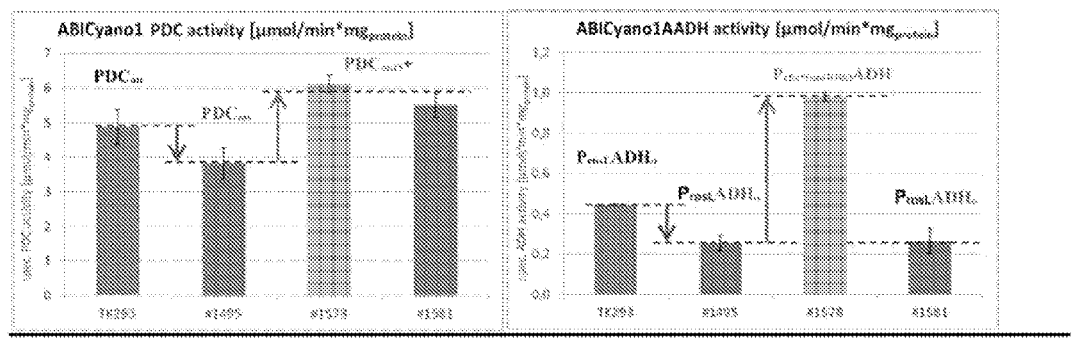
FIG. 38 depicts and compares (in the left panel) the PDC enzyme activity and (in the right panel) the ADH enzyme activity between ABICyano1 host cells each containing one of the plasmids TK293, #1495, #1578, and #1581.

FIG. 38 depicts and compares (in the left panel) the PDC enzyme activity and (in the right panel) the ADH enzyme activity between ABICyano1 host cells each containing one of the plasmids TK293, #1495, #1578, and #1581.

In an embodiment, transformed ABICyano1 cells containing ethanologenic cassettes are grown under inducing conditions in mBG11 medium, and may be tested for ethanol production. ABICyano1 containing the plasmids TK293 and TK225 produced 0.086% (v/v) and 0.019% (v/v) ethanol, respectively, over a 50 h period in an online GC vial system (FIG. 34). Cultivation of ethanologenic ABICyano1 cells was performed in 0.5 L round PBR glass vessels containing marine BG11 culture medium. pH was controlled via $CO_2$ flux. Cell growth and ethanol production are shown in FIG. 35 and FIG. 36 for ABICyano1 containing TK225 and TK293, respectively.

Genetically enhanced ABICyano1 containing extrachromosomal plasmids with a pdc gene under the transcriptional control of either the native nirA promoter, or modified variants thereof, were cultured in 0.5 L photobioreactors. These enhanced ABICyano1 variously contained plasmids #1606, #1629 and #1636. FIG. 28 shows the ethanol production normalized to growth ($OD_{750nm}$) as determined by the CG vial method for ABICyano1 transformed with plasmids #1606 (a pdc gene under the control of the native $P_{nirA}$), plasmid #1629 (a pdc gene under the control of a variant of $P_{nirA}$ with changes in the RBS) and plasmid #1636 (a pdc gene under the control of a modified variant of $P_{nirA}$ with changes in the operator sequence and the TATA box). Ethanol production was measured over a period of at least 20 days after induction. Induction of $P_{nirA}$ was realized by transition of the pre-culture to mBG11 medium containing nitrate for induction at the beginning of the cultivation experiment. FIG. 28 depicts that the normalized ethanol production is higher for ABICyano1 containing the plasmids with modified promoters. FIGS. 29 and 30 depict the specific activity of PDC enzyme and ADH enzyme during the course of cultivation. The inducible, modified nirA promoter variants PnirA*2 (#1629) and PnirA*3 (#1636) result in higher activity of PDC enzyme compared to the native promoter (#1606).

Figure 39A:
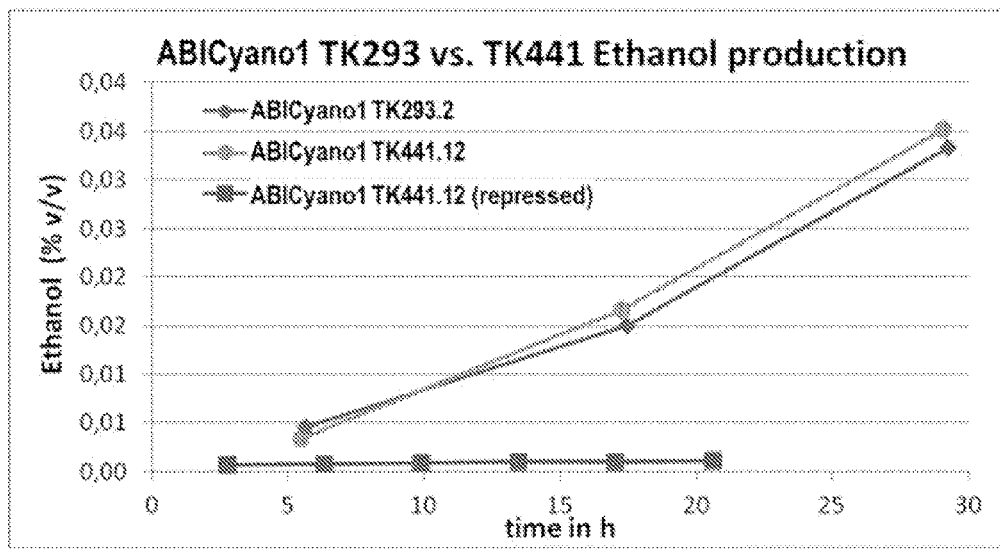
FIG. 39A and 39B depict ethanol production in an ABICyano1 TK441 strain having the endogenous $P_{petJ}$ upstream of an ethanologenic gene cassette producing the same amount of ethanol (percent v/v) under copper depletion (FIG. 39A) conditions as compared to an ABICyano1 TK293 strain grown in marine BG11 in FIG. 39B.
Figure 39B:
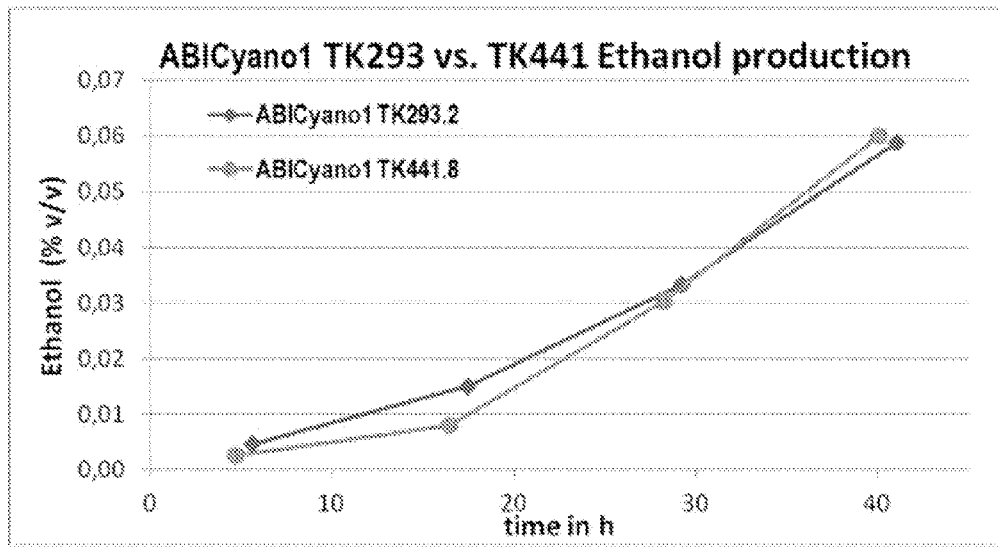

In an embodiment, a petJ promoter endogenous to ABICyano1 was identified and further characterized. Expression of $P_{petJ}$ is tightly repressed under high copper (1-3 μM) conditions and induced under copper depletion as depicted in FIG. 39A. An ABICyano1 TK441 strain having the endogenous $P_{petJ}$ upstream of an ethanologenic gene cassette produced the same amount of ethanol (percent v/v) under copper depletion conditions as compared to an ABICyano1 TK293 strain grown in marine BG11 (FIGS. 39A and 39B).

FIG. 31 depicts ethanol production, as determined by the GC vial method, normalized to growth, as represented by absorbance at $OD_{750nm}$, for ABICyano1 transformed with plasmids #1606 (a pdc gene under the control of the native $P_{nirA}$), plasmid #1631 (a pdc gene under the control of a modified $P_{corT}$ with modifications in the TATA box) and plasmid #1632 (a pdc gene under the control of a modified $P_{corT}$ with modifications in the TATA box and the RBS). Ethanol production was measured for a period of time of at least 20 days while the cells were cultured in 0.5 L photobioreactors. The value for ethanol production of ABICyano1 transformed with plasmid #1606 is close to the value for ethanol production of ABICyano1 transformed with plasmid #1632. The ethanol production of the ABICyano1 transformed with plasmid #1631 exhibits a lower ethanol production rate than ABICyano1 transformed with plasmids #1606 and #1632, especially in the time period starting from about the tenth day of cultivation.

FIGS. 32 and 33 depict the specific activity of PDC enzyme and ADH enzyme during the course of cultivation. ABICyano1 transformed with plasmids #1632 and #1606 demonstrated higher activity of PDC enzyme than ABICyano1 transformed with plasmid #1631.

Figure 40:
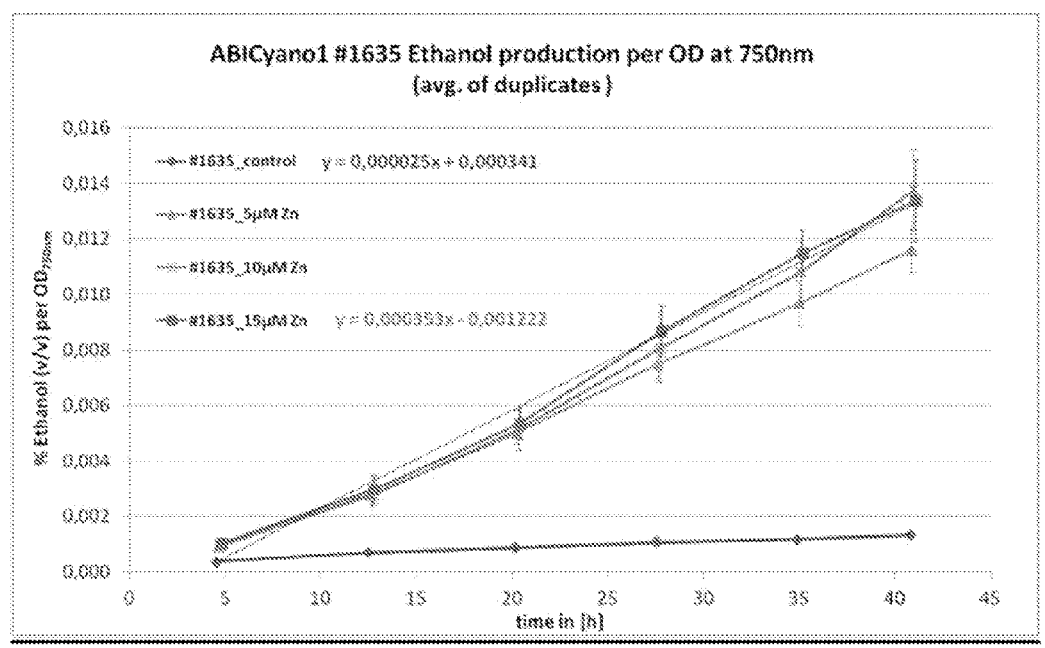
FIG. 40 depicts the ethanol production rate of the ABICyano1 transformed with plasmid #1635.
Figure 41:
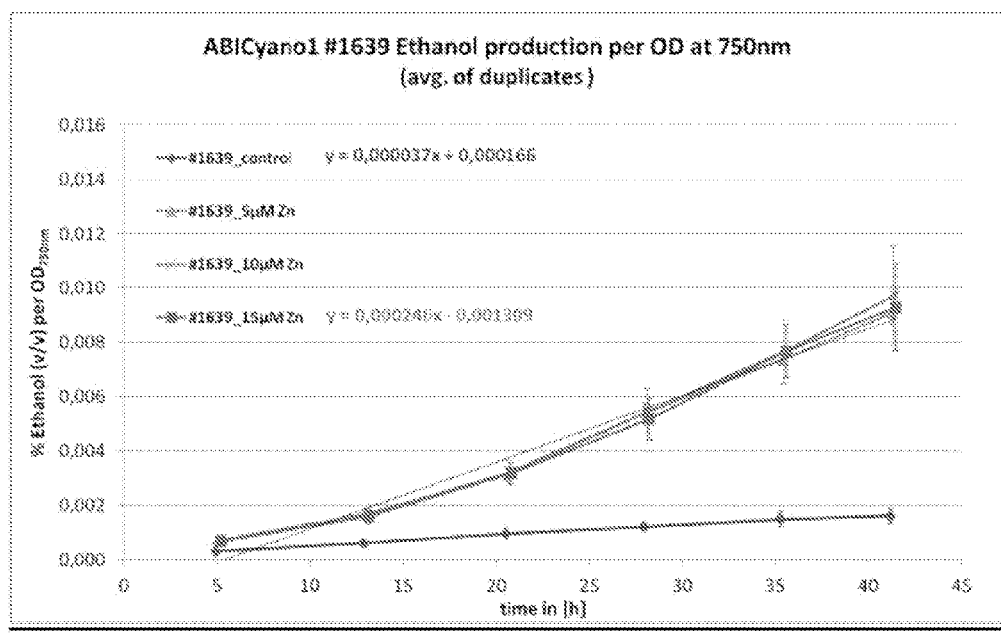
FIG. 41 depicts the ethanol production rate of the ABICyano1 transformed with plasmid #1639.
Figure 42:
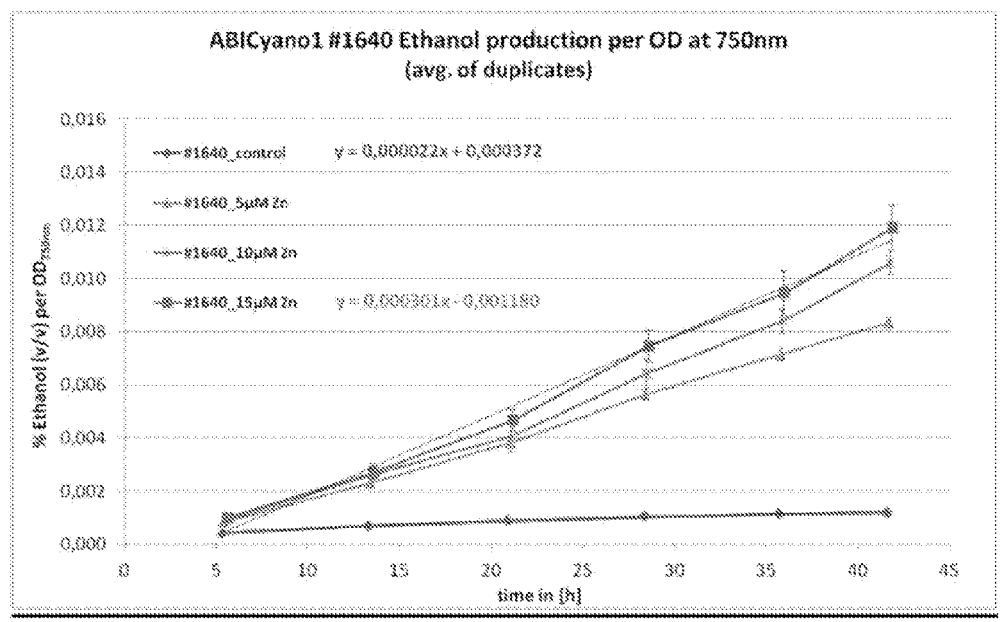
FIG. 42 depicts the ethanol production rate of the ABICyano1 transformed with plasmid #1640.

FIGS. 40, 41 and 42 depict the ethanol production rates of the ABICyano1 transformed with plasmid #1635, or plasmid #1639, or plasmid #1640, respectively. ABICyano1 strains containing plasmid #1635, or plasmid #1639, or plasmid #1640 all include the native $P_{smtA}$ from Synechococcus PCC 7002 as well as modified versions of $P_{smtA}$. FIGS. 40, 41 and 42 demonstrate that the promoters are repressed in the absence of $Zn^{2+}$ and can be induced upon addition of $Zn^{2+}$.

In an example, modified vectors such as TK293, and #1536, as described herein, each containing an ethanologenic cassette and an antibiotic resistance gene under the transcriptional control of an ABICyano1 and/or an endogenous promoter of Synechococcus PCC 7002, respectively, are transformed into Synechococcus PCC 7002 using electroporation, conjugation or natural uptake. The transfonnants are selected for on an agar plate using the appropriate antibiotic. The putative transformants are then confirmed by PCR analysis. Positive cells are streaked and scaled up to grow as a culture. Ethanol production is measured. By use of this method, ethanol would be produced using a p6.8 derived vector containing an ethanologenic cassette using organisms other than those of the genus Cyanobacterium and/or ABICyano1.

Continuous Production of Ethanol

FIG. 164 depicts the growth of TK293 (OD at 750 nm) which has an ethanologenic cassette with a pdc gene under control of the nirA promoter. As depicted in FIG. 164, TK293 was cultivated in a 0.5 L Crison PBR system and illuminated with 450 $\mu E*m^{-2}*s^{-1}$ from two sides depicts. In FIG. 164, the red arrows indicate dilution steps conducted in order to keep the culture productive.

FIG. 165 depicts the ethanol production of the non-naturally occurring ethanologenic ABICyano1 strain TK293 which has an ethanologenic cassette with a pdc gene under control of the nirA promoter. As depicted in FIG. 165, a single inoculum of TK293 was cultivated in repeated dilutions in a 0.5 L Crison PBR system illuminated with 450 $\mu E*m^{-2}*s^{-1}$ from two sides. In an embodiment. FIG. 165 depicts ethanol production from a single inoculum of TK293 over the course of 120 days. In an embodiment, about 2.89% (vol/vol) ethanol per bioreactor volume is produced as calculated by the sum of increase in percent ethanol (vol/vol) for each batch wherein all batches are derived from a single TK293 inoculum. In an embodiment, as depicted in FIG. 165, a first batch produces 0.65% ethanol (vol/vol) (rate of production is 0.0323% (vol/vol) per day), a second batch produces 0.25% ethanol (vol/vol) (rate of production is 0.0174% (vol/vol) per day), a third batch produces 0.17% ethanol (vol/vol) (rate of production is 0.0199% (vol/vol) per day), a fourth batch produces 0.43% ethanol (vol/vol) (rate of production is 0.0218% (vol/vol) per day), a fifth batch produces 0.48% ethanol (vol/vol) (rate of production is 0.0324% (vol/vol) per day), a sixth batch produces 0.46% ethanol (vol/vol) (rate of production is 0.0229% (vol/vol) per day), a seventh batch produces 0.37% ethanol (vol/vol) (rate of production is 0.0201% (vol/vol) per day), and an eighth batch produces 0.08% ethanol (vol/vol) (rate of production is 0.0136% (vol/vol) per day), the sum total of which is 2.89% (vol/vol) ethanol per bioreactor volume. In another embodiment, ethanol per bioreactor volume can be calculated by calculating the cummulative grams of ethanol produced per batch.

Improved Ethanologenic Gene Cassettes for ABICyano1

In an embodiment, ethanologenic ABICyano1 strains with improved properties in relation to a TK293 reference strain are disclosed. Ethanol production is obtained by improvement of the ethanologenic gene cassette. In an embodiment, variants of plasmid TK293 are used as a starting point for modifications that result in improved ethanologenic constructs. In an embodiment, the constructs contain a pdc gene from Zymomonas mobilis under the control of a nirA promoter. Some constructs contain a codon-optimization Z. mobilis pdc gene (zmpdc) whose expression is controlled by an endogenous nirA promoter.

In an embodiment, the ethanologenic cassettes contain a synadh gene that is codon-optimized (synadh(opt1)). In an embodiment, the expression of synADH(opt1) is controlled by the endogenous rpsL promoter.

ABICyano1 strains containing the following constructs were tested for ethanol production, cell growth, ADH activity, and PDH activity:

TK293 [p171-6.8_PnirA-zmPDC(opt1)-PrpsL-synADH(opt1)_ter]
1495 [p171-6.8_PnirA-zmPDC(opt3)-PrpsL-synADH(opt3)_ter]
1578 [p171-6.8_PnirA-zmPDC(opt3)_dsrA-Prbc*(optRBS)-synADH_ter]
1580 [p171-6.8_PnirA-zmPDC(opt1)_dsrA-PrpsL-synADH(opt1)_ter]
1581 [p171-6.8_PnirA-zmPDC(opt3)_dsrA-PrpsL-synADH(opt3)_ter]
1601 [p171-6.8_PnirA-zmPDC(opt1)_dsrA-Prbc*(optRBS)-synADH(opt3)_ter]
1606 [p171-6.8_PnirA-zmPDC(opt1)_dsrA-Prbc*(optRBS)-synADH(opt1)_ter]
TK411 [p171-6.8_PnirA-zmPDC(opt3)-PrpsL-synADH(opt1)_ter]
TK412 [p171-6.8_PnirA-zmPDC(opt1)-PrpsL-synADH(opt3)_ter]

Figure 43:
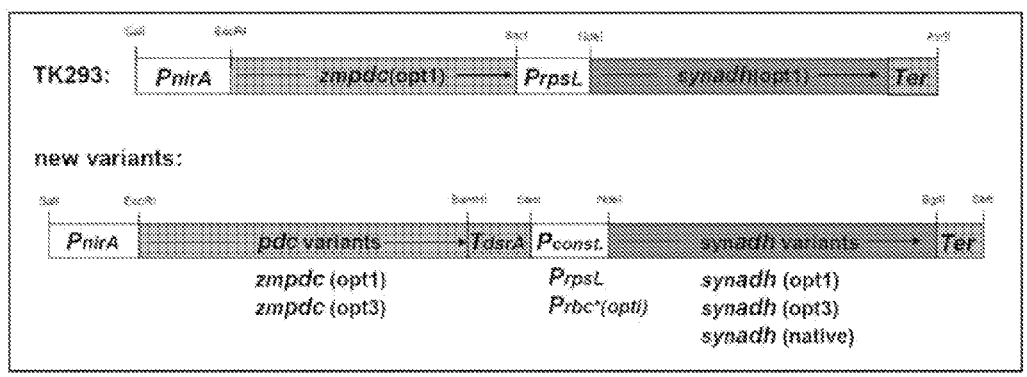
FIG. 43 depicts different variations of the components of the ethanologenic gene cassettes.

As depicted in FIG. 43, different variations of the components of the ethanologenic gene cassette were created. In an embodiment, one of the resulting constructs #1578 resulted in an improved ethanol production rate compared to TK293. Construct #1578 included the zmpdc gene with a third version of codon-optimization, an additional introduced transcriptional terminator dsrA, and the native synadh gene whose expression is controlled by the artificial rbc*(optRBS) promoter which is an improved variant of the rbcL promoter derived from *Synechocystis* PCC 6803.

Figure 44:
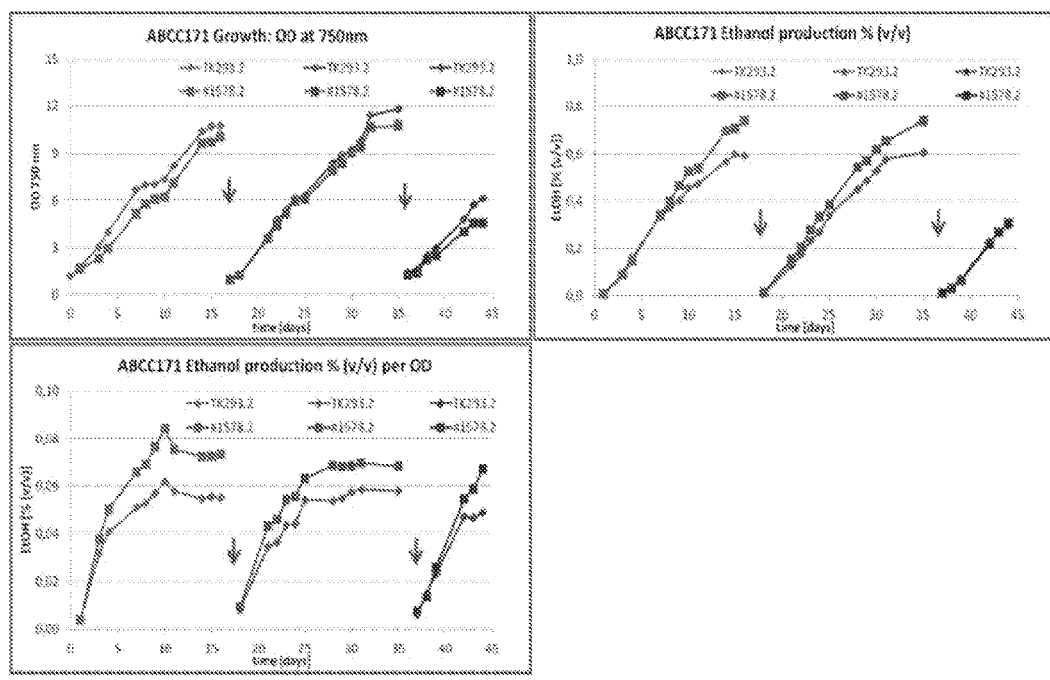
FIG. 44 depicts cell growth, ethanol production and $OD_{750}$ normalized ethanol production of ABICyano1 with TK293 or #1578.
Figure 45:
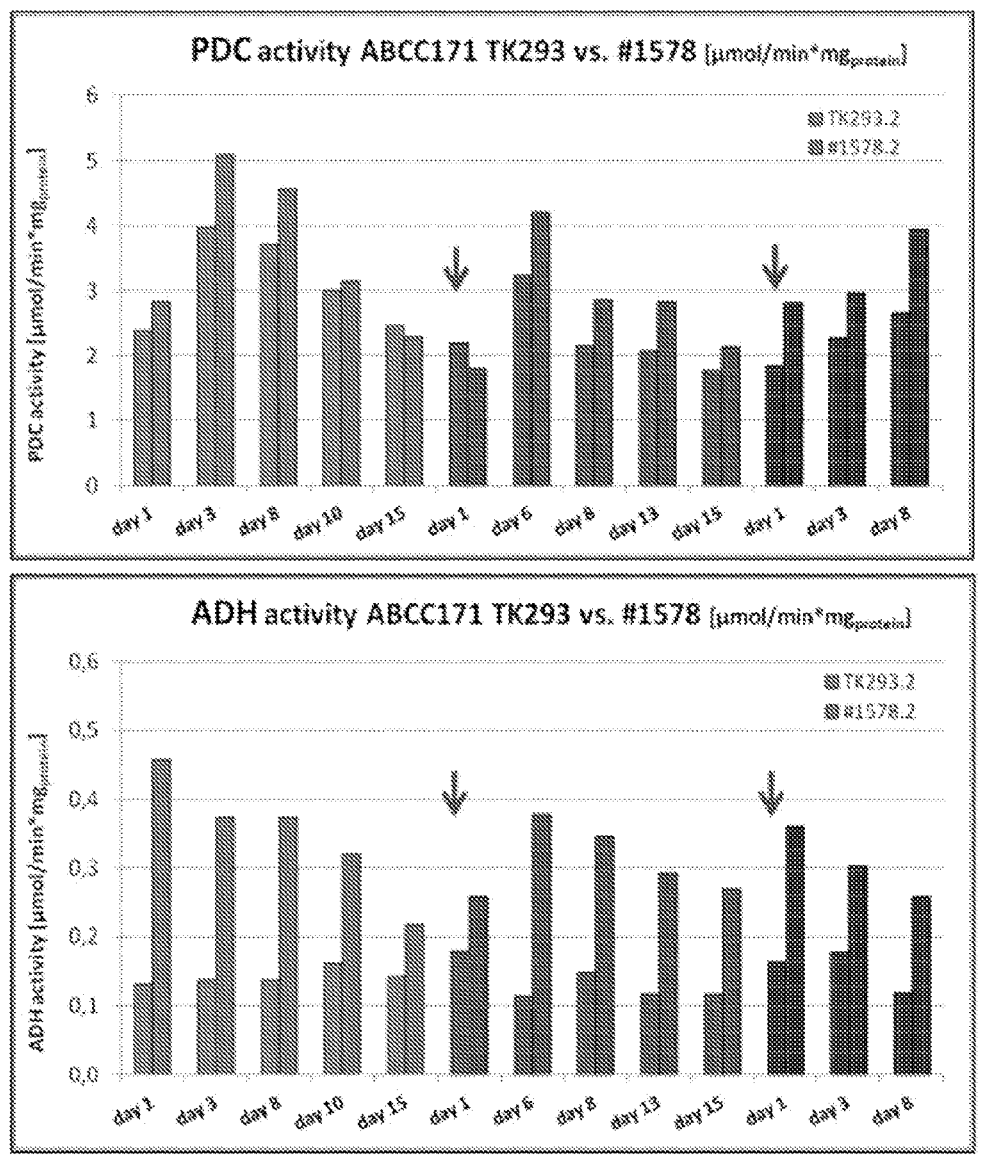
FIG. 45 depicts PDC and ADH activity in ABICyano1 with TK293 or #1578.
Figure 46:
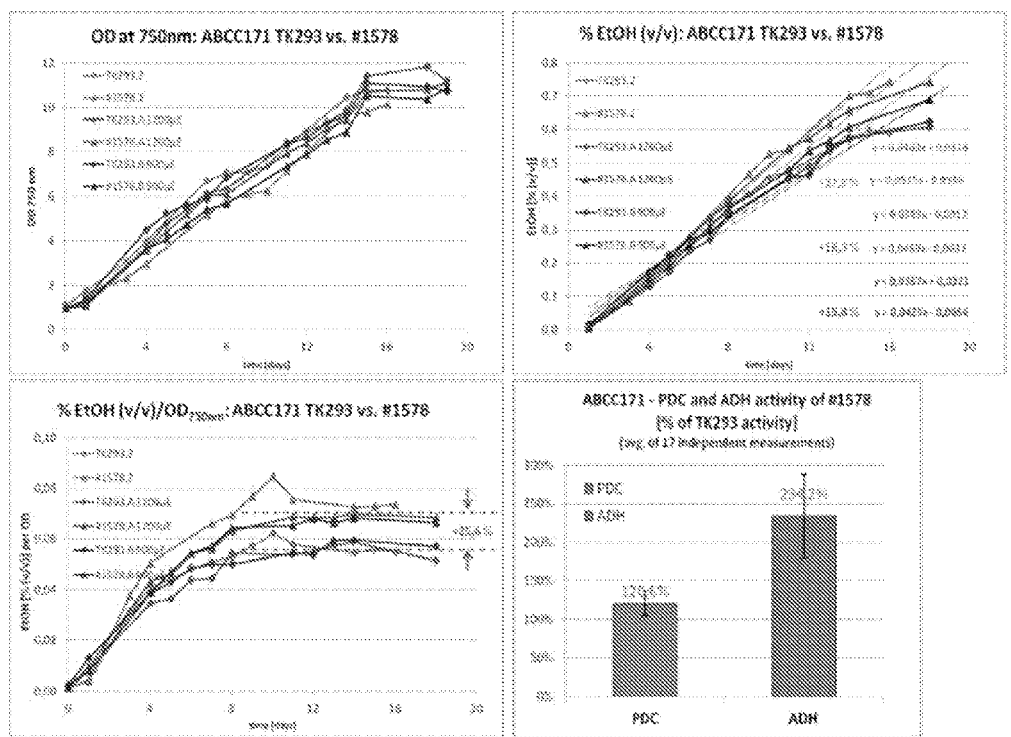
FIG. 46 depicts overlays of the curve progression in regard to cell growth, overlays of the curve progression in regard to ethanol production, overlays of the curve progression in regard to the ethanol production rate and a comparison of the PDC and ADH activity between ABICyano1 #1578 and ABICyano1 TK293.

FIG. 44 depicts cell growth, ethanol production and normalized ethanol production of ABICyano1 with TK293 or #1578. FIG. 45 depicts PDC and ADH activity in ABICyano1 with TK293 or #1578. FIG. 46 depicts overlays of the curve progression in regard to cell growth, overlays of the curve progression in regard to ethanol production, overlays of the curve progression in regard to the ethanol production rate and a comparison of the PDC and ADH activity between ABICyano1 #1578 and ABICyano1 TK293. As depicted in FIGS. 44 to 46, both components in combination with the additional terminator in between both genes result in an increased PDC as well as ADH activity over time which consequently lead to a higher ethanol production rate and at the same time reduced growth rate. This observation indicates a higher carbon-partitioning (amount of carbon fixed into ethanol versus fixed into biomass) for strain ABICyano1 #1578 compared to ABICyano1 TK293 and demonstrates the high potential of optimizing the ethanologenic gene cassette in order to improve the ethanol productivity for ABICyano1 and other cyanobacteria.

As depicted in FIG. 38, ADH expression is controlled by promoter PrpsL. The expression level of the synADHopt3 cassette present in #1495 and #1581 is apparently less efficient compared to the expression level of the synADHopt1 present in ABICyano1 TK293 and ABICyano1 #1580. Not being limited by theory, this might be explained by the different codon-usage strategy applied for the synADHopt1 gene version as exemplified through testing constructs TK411 and TK412, comprising synADH(opt1) and synADH(opt3) respectively. TK411 exhibited a similar ADH activity as TK293 whereas TK412 revealed a relatively low ADH activity. This low ADH activity detected for TK412 was accompanied with an elevated acetaldehyde accumulation as found previously for #1495 and #1581, both with synADH (opt3). This clearly demonstrates the better performance of synADH(opt1) in relation to synADH(opt3).

Furthermore, analyses of ADH activity from ABICyano1 strains #1601 and #1606 confirmed the different efficiency when using synADH(opt3) vs. synADH(opt1). Strain #1601 [p171-6.8_PnirA-zmPDC(opt1)_dsrA-Prbc* (optRBS)-synADH(opt3)_ter] exhibited a relatively low ADH activity and consequently a higher acetaldehyde accumulation in GC vial assay whereas the experiments with strain #1606 [p171-6.8_PnirA-zmPDC(opt1)_dsrA-Prbc* (optRBS)-synADH(opt1)_ter] indicated a higher ADH activity in relation to #1601 and thus a lower acetaldehyde accumulation. Nevertheless, the highest activity found for the different gene variants of synADH was surprisingly accomplished by the native synADH (ABICyano1 #1578) without any codon-optimization for use in ABICyano1. Codon optimization is usually needed for efficient protein expression in ABICyano1 because it has a strong AT bias in endogenous codon-usage.

Figure 47:
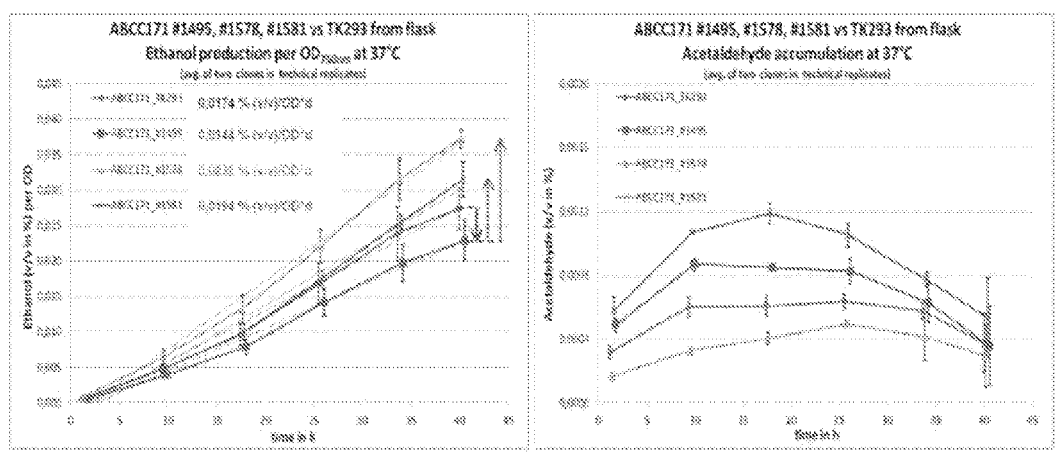
FIG. 47 depicts improved ethanol production and reduced acetaldehyde accumulation for ABICyano1 #1578 in relation to ABICyano1 TK293. The alterations in activity of PDC and synADH observed for ABICyano1 #1578 enhanced ethanol productivity in ABICyano1 by about 20-25%.

Although strains ABICyano1 #1495 and ABICyano1 #1581 differ in the dsrA terminator downstream from the pdc gene, the PDC expression in ABICyano1 #1581 was found to be substantially increased, see FIG. 47. This is an indication that introduction of an efficient transcript termination signal apparently results in a higher and/or more stable mRNA levels and consequently in an increased PDC protein expression. In ABICyano1 #1578 growth is thereby reduced but the ethanol production is significantly increased demonstrating that the improved PDC expression results in an improved relative production of ethanol in comparison to biomass.

The data depicted in table 5 demonstrate the improved (when compared to TK293) production rate of ethanol as well as the reduced acetaldehyde accumulation due to elevated PDC and ADH activities for ABICyano1 that has been genetically enhanced with construct #1578. FIGS. 44 and 45 depict the cultivation of the corresponding cell lines TK293 and #1578 performed in 0.5 L Crison PBR round bottles illuminated from two sides with 450 µE m$^{-2}$s$^{-1}$ (900 µEm$^{-2}$s$^{-1}$ total) for about 45 days including two dilution steps (see FIGS. 44 and 45). During this long term cultivation the OD, the chlorophyll content, and the ethanol amount were measured.

TABLE 5

| construct | avg. GC rate [% EtOH(v/v)/OD$_{avg}$* d] | production rate in relation to TK293 | avg. Acetaldehyde conc. [% MeCHO (v/v)] | Acetaldehyde conc. in relation to TK293 |
|---|---|---|---|---|
| TK293 | 0.0239 +/− 0.0007 | 100% | 0.000618 +/− 0.00004 | 100% |
| #1495 | 0.0225 +/− 0.0010 | 94% | 0.000818 +/− 0.00013 | 132% |
| #1578 | 0.0307 +/− 0.0012 | 128% | 0.000303 +/− 0.00005 | 49% |
| #1581 | 0.0300 +/− 0.0006 | 125% | 0.000832 +/− 0.00016 | 135% |

Figure 48:
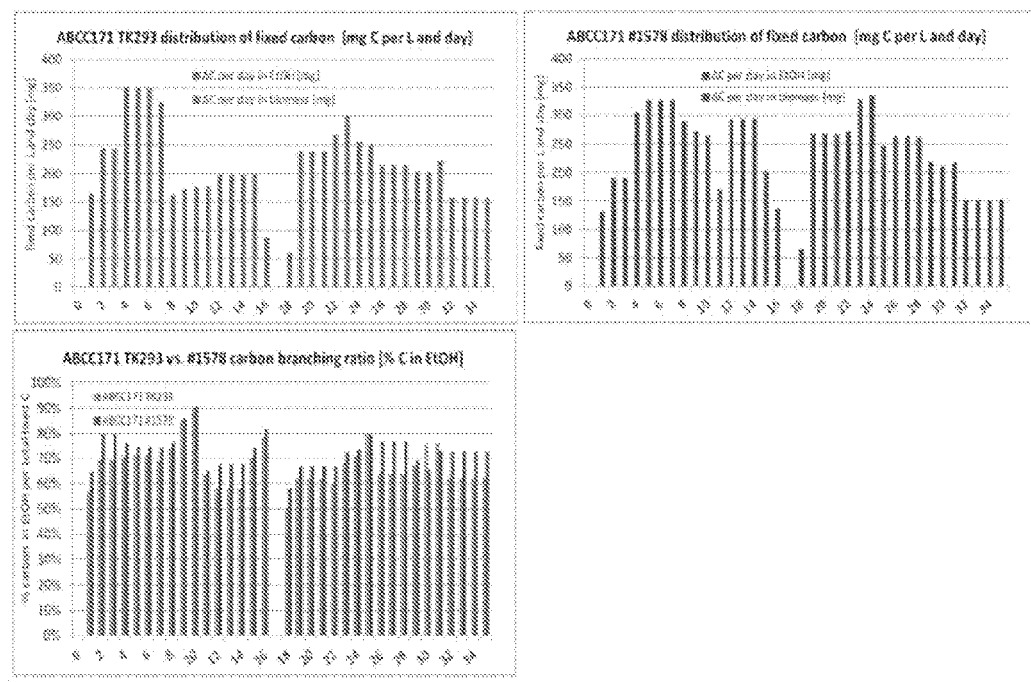
FIG. 48 depicts the higher ethanol production rate and lower growth for ABICyano1 #1578 as compared to TK293 and shows that PDC regulates the partitioning of carbon fixed by photosynthesis into biomass and ethanol.

As depicted in FIG. 47, the introduction of alterations in the ethanologenic gene cassette resulted in improved expression and improved activity of PDC and synADH. The alterations enhanced ethanol productivity in ABICyano1 by about 20-25%. While not being limited by theory. FIG. 48 depicts the higher ethanol production rate and lower growth for ABICyano1 #1578 as compared to TK293 and shows that PDC regulates the partitioning of carbon fixed by photosynthesis into biomass and ethanol. ABICyano1 #1578 thus increases total carbon fixation and ethanol production by about 10% compared to ABICyano1 TK293.

Figure 49:
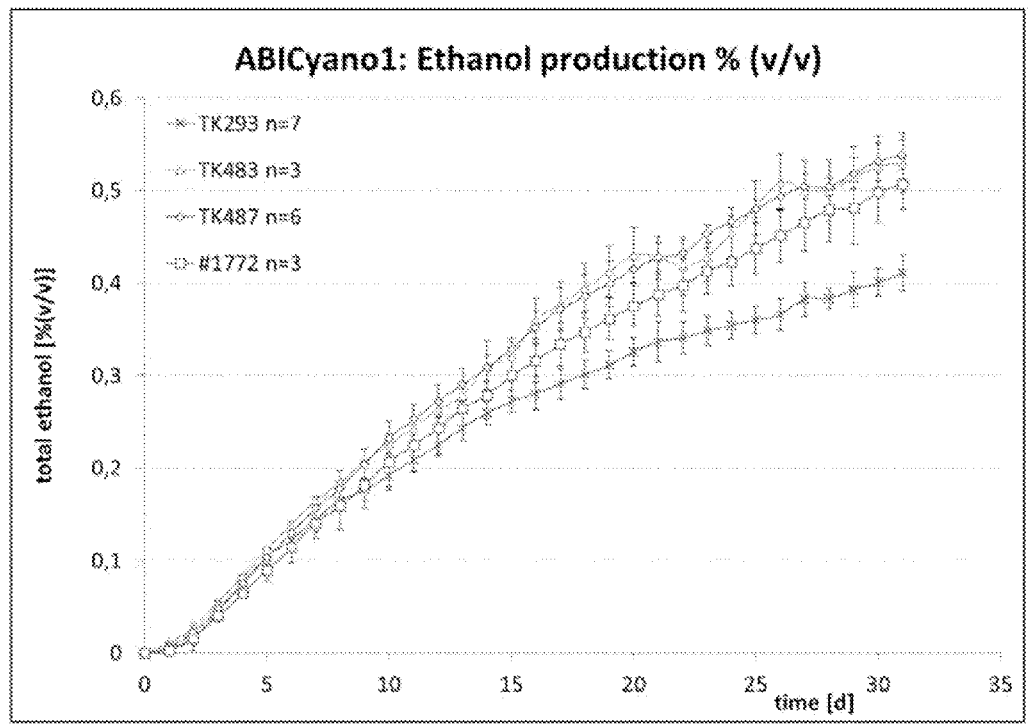
FIG. 49 depicts ethanol production in several ABICyano1 strains including copper-inducible promoters controlling the pdc expression.

FIG. 49 depicts ethanol production in several ABICyano1 strains including copper-inducible promoters controlling the pdc expression. As depicted in FIG. 49, strain TK483 which contains $P_{orf0221}$, strain TK487 and strain #1772 which both contain $P_{orf0316}$ produce more ethanol over the same amount of time than does strain TK293 that contains a $P_{nirA}$ promoter controlling the pdc expression. All of the strains depicted in FIG. 49 were cultivated in a vPBR system at 230 µE*m$^{-2}$*s$^{-1}$ (illuminated from one side) in a 12 h/12 day/night cycle.

Ethanol Production by ABICyano1 Using Endogenous Metal Inducible Promoters

Figure 50:
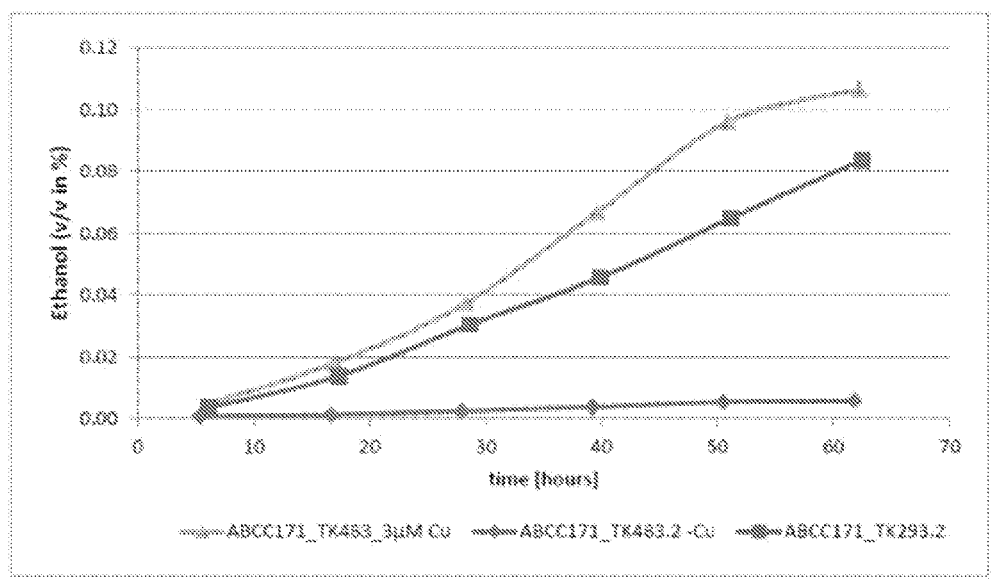
FIG. 50 depicts the ethanol production of ABICyano1 TK293 (pABICyano1-6.8::PnirA-PDC(opt1)-PrpsL-syn-ADH(opt1)_ter) compared to ABICyano1 TK483 (pABICyano1-6.8::Porf0221-zmPDC_(opt1)dsrA-Prbc*(optRBS)-ADH111(opt)_ter) in the presence and absence of 3 µM $Cu^{2+}$.
Figure 125:
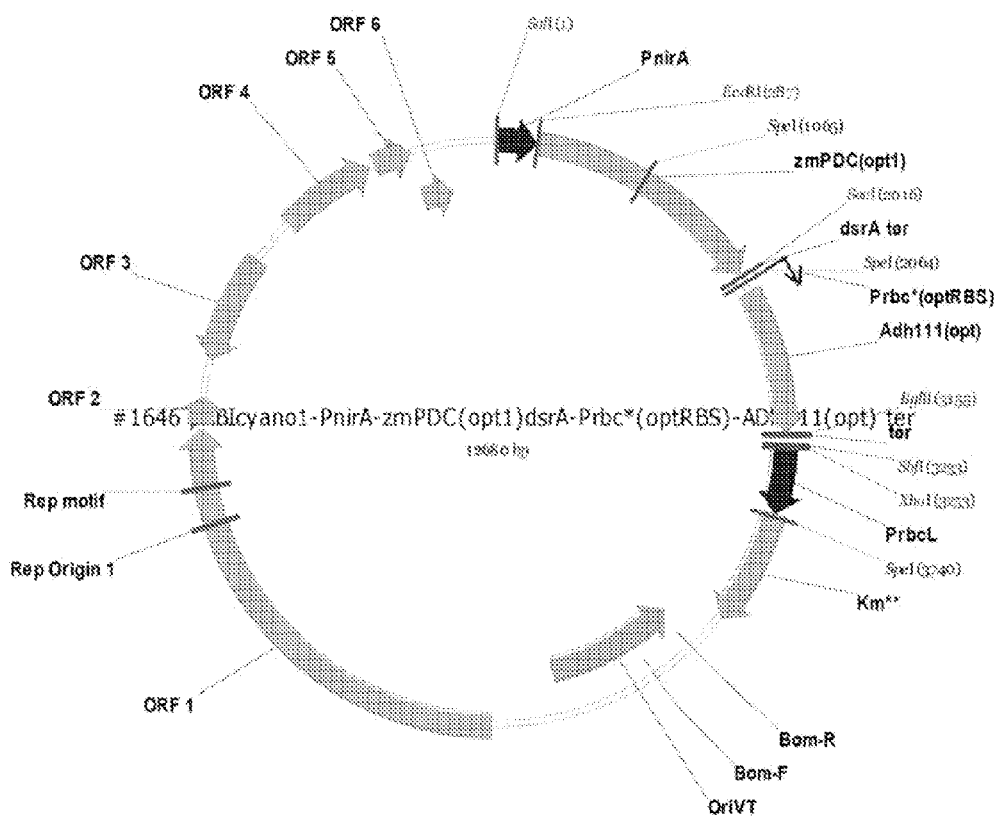

Promoters controlling the open reading frames found to be regulated by addition of the respective metal ions (based on RNAseq data and verified by qRT-PCR) were chosen to be used in constructs for ethanol production in ABICyano1. In an embodiment, a 300-500 bp fragment upstream of each start codon was selected and cloned into plasmid #1646 ((pABIcyano1-PnirA-zmPDC(opt1)dsrA-Prbc*(optRBS)-ADH111 (opt)_ter) whose plasmid map is depicted in FIG. 125 (SEQ ID NO: 75), replacing the nirA promoter, in order to drive pdc transcription. ABICyano1 transformants were tested for ethanol productivity under repressed and induced conditions in GC vial experiments. FIG. 50 depicts the ethanol production of ABICyano1 TK293 (p171-6.8::PnirA-PDC(opt1)-PrpsL-synADH(opt1)_ter) compared to ABICyano1 TK483 (p171-6.8::Porf0221-zmPDC_(opt1)dsrA-Prbc*(optRBS)-ADH111(opt)_ter) in the presence and absence of 3 µM Cu$^{2+}$. In the absence of copper, ethanol production rates are very low, indicating the tightness of Porf0221. By contrast, ethanol production of ABICyano1 TK483 in the presence of 3 µM Cu$^{2+}$ is even higher compared to ABICyano1 TK293.

The ethanol productivity (percent ethanol (v/v)/OD/day) of each construct is shown in table 6 under repressed (without the respective metal ion) and induced conditions (10 µM Ni$^{2+}$, 15 µM Zn$^{2+}$, 3 µM Cu$^{2+}$ or 5 µM Co$^{2+}$). Tightness and strength of each promoter were also rated with a +/− scale, (see legend below Table 3). In an embodiment, ethanol production rates of all tested promoters can be divided into different categories as follows: 1) ethanol productivity was very low, even under inducing conditions (e.g. TK500), 2) ethanol productivity was quite high, however, the promoter was not repressible (e.g. TK501) and 3) ethanol productivity was quite high and promoter repressible/inducible (e.g. TK483). In some cases two constructs were generated for one promoter (e.g. TK493/TK527 for Porf0128), as two putative start codons for the respective gene could be deduced.

In another embodiment, producer ABICyano1 host cell strains were hybrids carrying the inducible constructs TK480 and TK490 as well as the Cu$^{2+}$ inducible TK483, TK487 and TK504. All five constructs are very tightly repressed under appropriate conditions (lack of inducer metal) and led to high ethanol production rates after metal ion addition. TK480 uses a mntC promoter, which was shown in Synechocystis PCC 6803 to be regulated by manganese (Ogawa et al., 2002). Hence repression by addition of Mn$^{2+}$ was tested, see table 6, and addition of 40-50 µM Mn$^{2+}$ led to a repression.

Thus, orf0221 encodes for a putative multi-copper oxidase (copper-resistance protein), while orf0223 and orf0316 are hypothetical genes with unknown function. All three genes/proteins are believed to have not been previously described in the literature, induction by copper was not known. Based on homology to other copper regulated genes, none of the three endogenous promoters from ABICyano1 would have been chosen to control pdc expression. However, the three promoters respond strongly to copper and were shown to tightly control ethanol production in ABICyano1. Because the response to copper declines within about 5 days, additional copper needs to be supplemented during long term ethanol production experiments. In an embodiment, the copper repressible promoter of petJ (orf3461) is useful. No ethanol production was observed with the promoter of orf3232, encoding for a heavy metal ATPase. As the copper response stayed at a constant level up to about day 5, the promoter of orf3232 could be useful for longer productivity. Not being bound by theory, one explanation is that both cloned translational start codons are selected in the upstream region of about 500 bp and might not use the entire functional promoter.

In another embodiment, the Zn$^{2+}$ responding promoter of the smtA like orf3126 improved amounts of produced ethanol. However, basal (repressed) production rates were too high. Additional genetic improvement of Porf3126 could enhance the tightness of control for expression of PDC and ethanol production in non-natrually occurring ethanologenic ABICyano1 organisms. By contrast, the Zn$^{2+}$ responding promoter of the manganese transporter operon (mntC) is substantially repressed by addition of 40 µM Mn$^{2+}$.

TABLE 6

| construct | ABICyano1 promoter | gene | inductor/ repressor | tightness | strength | % EtOH(v/v)/OD/d repressed | % EtOH(v/v)/OD/d induced |
|---|---|---|---|---|---|---|---|
| TK493/TK527 | _orf0128 | | −Ni | | | no | no |
| TK501 | _orf1486 | | +Ni | − | +++ | 0.021 | 0.024 |
| TK502 | _orf3164 | | +Ni | ++ | − | 0.002 | 0.003 |
| TK500 | _orf3293 | | −Ni | ++ | − | 0.003 | 0.004 |
| TK491 | _orf3621 | | +Ni | ++ | − | 0.003 | 0.007 |
| TK492 | _orf3635 | oprB | −Ni | −− | ++ | 0.018 | 0.017 |
| TK480* | _orf1071 | mntC | +Zn/+Mn | ++ | +++ | 0.004 (40 µM Mn2+) | 0.025 |
| TK481 | _orf1072 | mntA | +Zn | | | no | no |
| TK482/TK528 | _orf1074 | mntB | +Zn | | | no | no |
| TK503 | _orf1075 | | +Zn | | | no | no |
| TK489 | _orf1542 | | +Zn | −− | ++ | 0.015 | 0.021 |
| TK488 | _orf1823 | sigH | +Zn | ++ | + | 0.003 | 0.011 |
| TK490* | _orf3126 | | +Zn | − | +++ | 0.007 | 0.02 |
| TK483* | _orf0221 | | +Cu | ++ | ++ | 0.001 | 0.023 |
| TK484 | _orf0222 | | +Cu | | | no | no |
| TK504* | _orf0223 | | +Cu | ++ | +++ | 0.007 | 0.035 |
| TK487* | _orf0316 | | +Cu | ++ | +++ | 0.003 | 0.021 |
| TK485/TK529 | _orf3232 | pacS | +Cu | | | no | no |
| TK441 | _orf3461 | petJ | −Cu | ++ | ++ | no | 0.018 |
| TK486 | _orf3749 | | +Co | | | 0.001 | 0.001 |

Thus, at least three Cu$^{2+}$ responding (Porf0221, Porf0223 and Porf0316) and two Zn$^{2+}$ responding promoters (Porf1071 and Porf3126) are useful as promoters to drive pdc expression ABICyano1 ethanologenic strains.

In an embodiment, the sequences, putative operator regions, putative −10 regions, putative transcription starting points, start codons, and putative ribosome binding sites of endogenous copper inducible promoters Porf0316, Porf3416 (PpetJ, and zinc inducible promoters Porf3126 (PsmtA-like), Porf1071 (PmntC, also manganese inducible) are depicted in FIG. 51.

In an embodiment, a transcription terminator can be present between the first and second recombinant gene in order to ensure a separate transcriptional control of the first and second recombinant gene and to provide for a high production of a compound of interest, such as ethanol. In an embodiment for an ethanologenic cassette used to produce ethanol as a compound of interest, a first recombinant gene encodes pyruvate decarboxylase and the second recombinant gene encodes alcohol dehydrogenase. The first recombinant gene (pdc) is under the transcriptional control of a first inducible promoter and the second recombinant gene (adh) is under the transcriptional control of a second constitutive promoter. The first inducible promoter can be selected from, for example, PnirA, variants PnirA*2, PnirA*3, PnirA*4, PmntC, P$_{orf3126}$, P$_{orf0221}$, P$_{orf0223}$, and P$_{orf0316}$ and the second constitutive promoter can be selected from, for example, PrpsL*4, Prbc*(optRBS), and PcpcB.

RNA-seq experiments were conducted in order to identify potential metal-ion inducible promoters in ABICyano1. The upstream regions of the metal-ion responding/inducible genes in ABICyano1, listed in the table below, were selected to drive/control expression of the ethanologenic gene cassette in ABICyano1. The nucleic acid sequences are given in the Figures as listed in this table. All of the below potential inducible promoters are prime candidates for the transcriptional control of the at least one recombinant gene. Expression of petJ is tightly repressed under high copper (1-3 µM) conditions and induced under copper depletion (FIG. 39). ABICyano1 TK441 strains carrying the endogenous petJ promoter upstream of an ethanologenic gene cassette, produce the same amount of ethanol (% v/v) under copper depletion conditions compared to an ABICyano1 TK293 strain grown in marine BG11 (FIGS. 39A and 39B).

Figure 52:
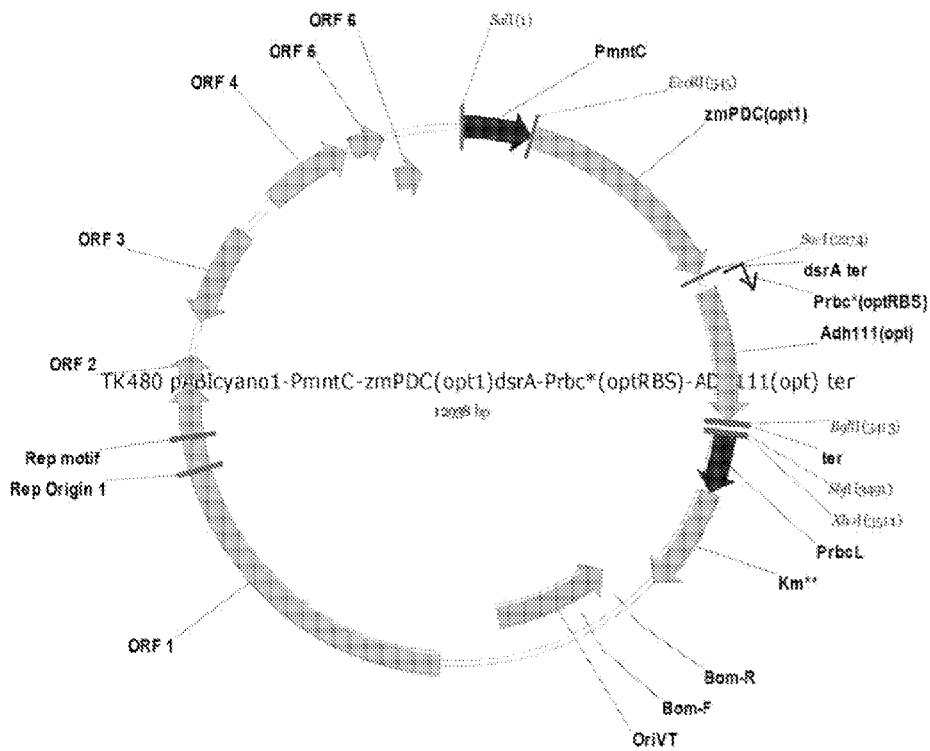
FIG. 52 depicts a plasmid map with sequence annotation of TK480 (pABIcyano1-PmntC-zmPDC(opt1)dsrA-Prbc*(optRBS)-ADH111(opt)_ter).

A plasmid map for TK480 (pABICyano1-6.8::PmntC ABICyano1-zmPDC(opt1)dsrA-Prbc*(optRBS)-ADH111 (opt)) is depicted in FIG. 52. The sequence of TK480 is listed in SEQ ID NO: 60.

Figure 53:
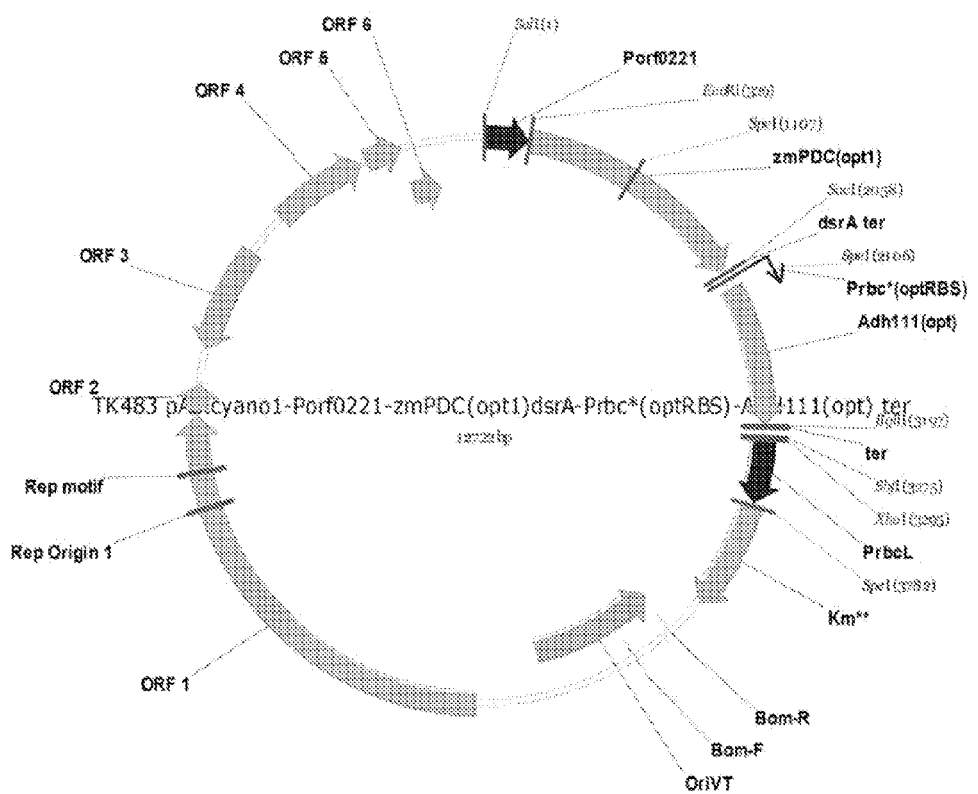
FIG. 53 depicts a plasmid map with sequence annotation for TK483 (pABIcyano1-Porf0221-zmPDC(opt1)dsrA-Prbc*(optRBS)-ADH111(opt)_ter).

A plasmid map for TK483 (pABICyano1-6.8::Porf0221-zmPDC(opt1)dsrA-Prbc*(optRBS)-ADH111(opt)) is depicted in FIG. 53. The sequence of TK483 is listed in SEQ ID NO: 61.

Figure 54:
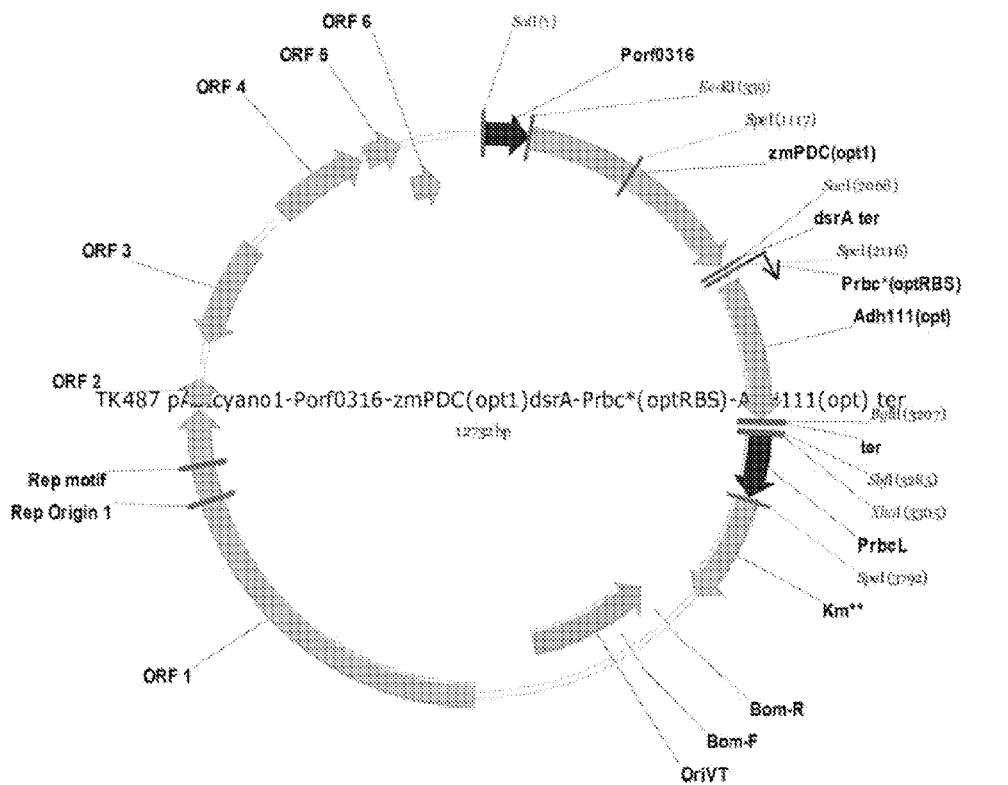
FIG. 54 depicts a plasmid map with sequence annotation for TK487 (pABIcyano1-Porf0316-zmPDC(opt1)dsrA-Prbc*(optRBS)-ADH111(opt)_ter).

A plasmid map for TK487 (pABIcyano1-Porf0316-zmPDC(opt1)dsrA-Prbc*(optRBS)-ADH111(opt)_ter) is depicted in FIG. 54. The sequence of TK487 is listed in SEQ ID NO: 62.

A plasmid map for TK488 (pABICyano1-6.8::PsigHABICyano1-zmPDC(opt1)dsrA-Prbc*(optRBS)-ADH111(opt)) is depicted in FIG. 55. The sequence of TK488 is listed in SEQ ID NO: 63.

Figure 56:
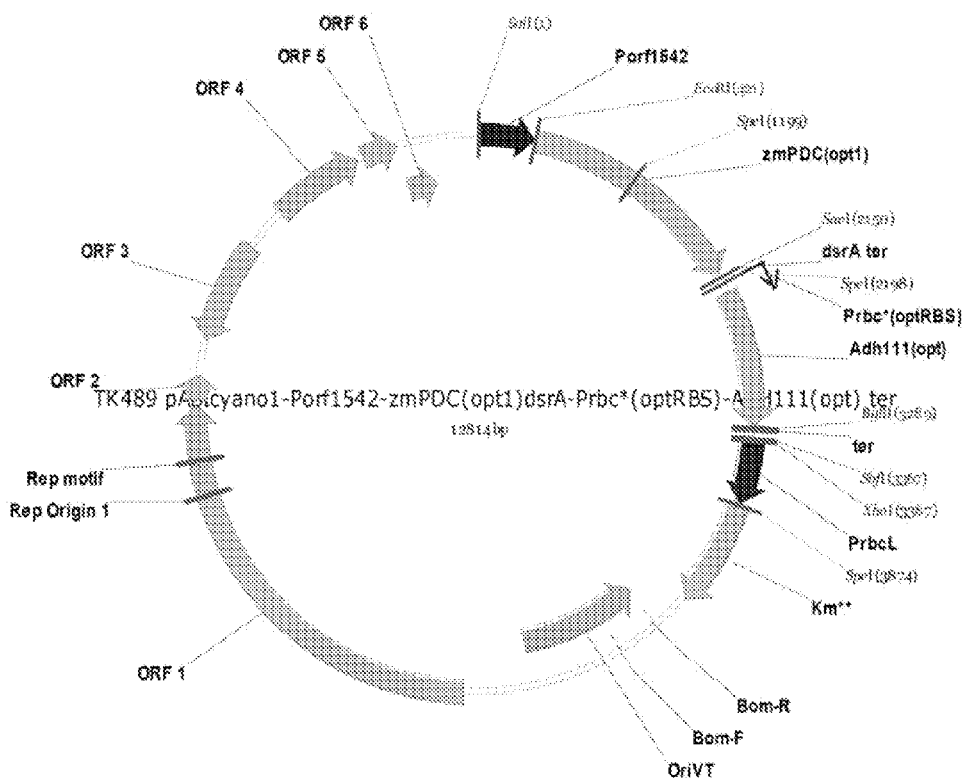
FIG. 56 depicts a plasmid map with sequence annotation for TK489 (pABIcyano1-Porf1542-zmPDC(opt1)dsrA-Prbc*(optRBS)-ADH111(opt)_ter).

A plasmid map for TK489 (pABICyano1-6.8::Porf1542-zmPDC(opt1)dsrA-Prbc*(optRBS)-ADH111(opt)) is depicted in FIG. 56. The sequence of TK489 is listed in SEQ ID NO: 64.

Figure 57:
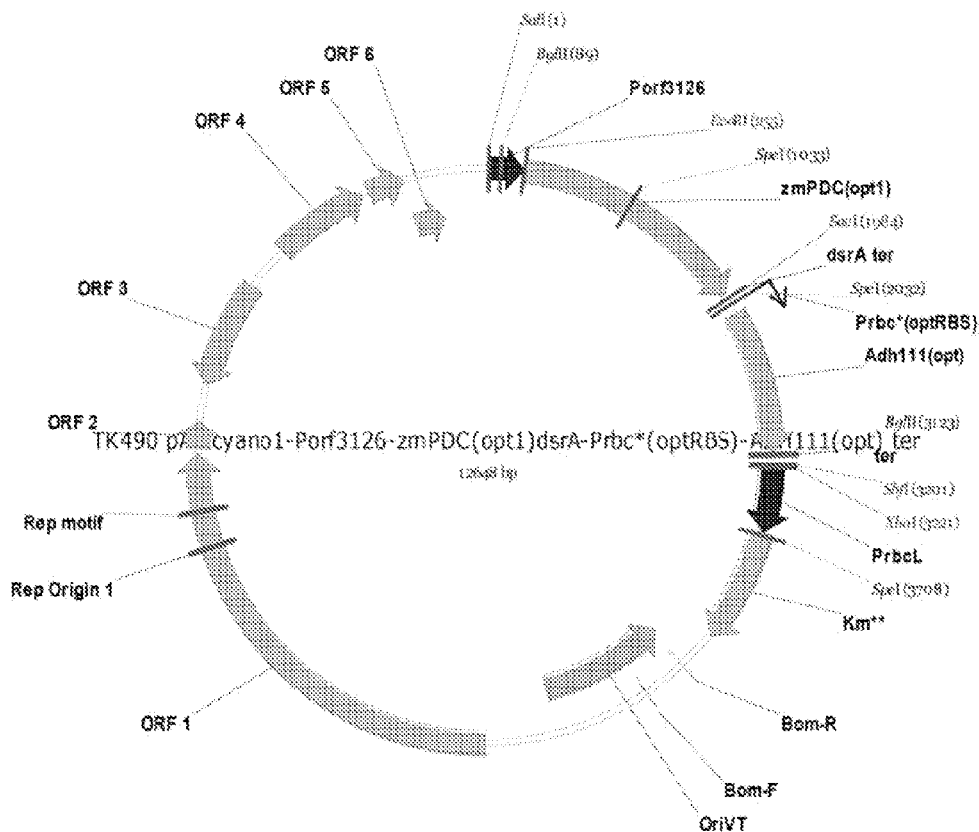
FIG. 57 depicts a plasmid map with sequence annotation for TK490 (pABIcyano1-Porf3126-zmPDC(opt1)dsrA-Prbc*(optRBS)-ADH111(opt)_ter).

A plasmid map for TK490 (pABICyano1-6.8::Porf3126-zmPDC(opt1)dsrA-Prbc*(optRBS)-ADH111(opt)) is depicted in FIG. 57. The sequence of TK480 is listed in SEQ ID NO: 65.

Figure 58:
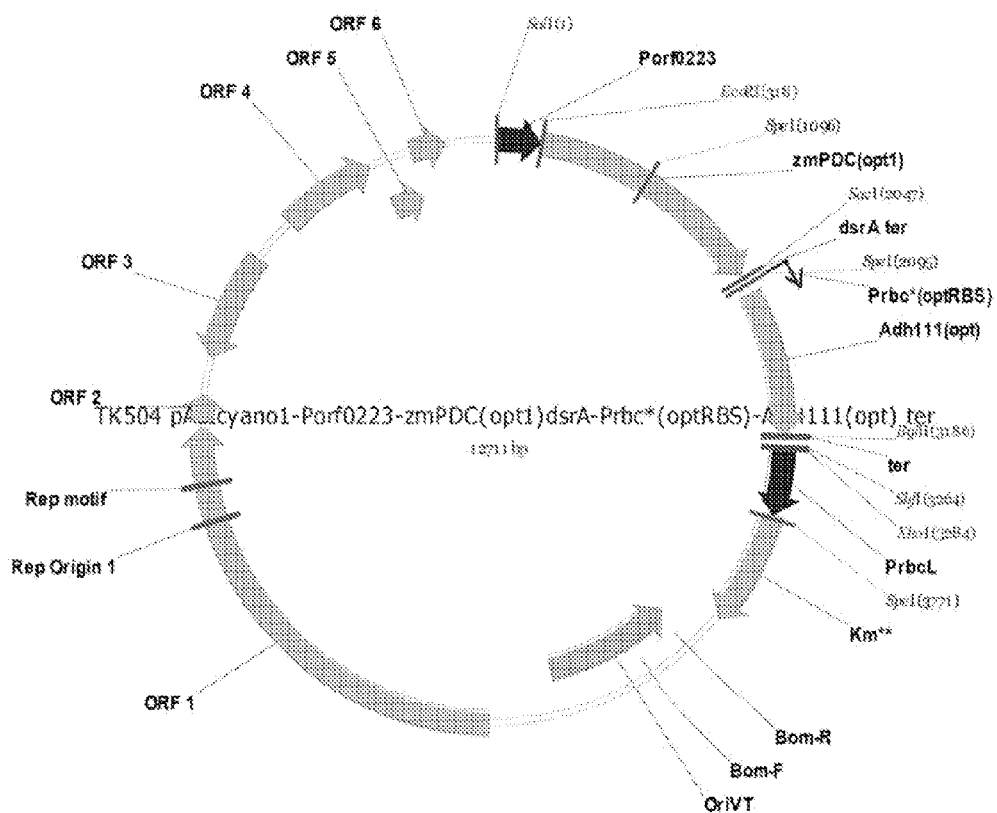
FIG. 58 depicts a plasmid map for TK504 (pABIcyano1-Porf0223-zmPDC(opt1)dsrA-Prbc*(optRBS)-ADH111(opt)_ter).

A plasmid map for TK504 (pABICyano1-6.8:: Porf0223_ABICyano1-zmPDC(opt1)dsrA-Prbc*(optRBS)-ADH111(opt)) is depicted in FIG. 58. The sequence of TK504 is listed in SEQ ID NO: 66.

FIGS. 59 to 66 depict the ethanol production of various different ABICyano1 strains carrying different metal-inducible promoters upstream of the pdc gene determined by the GC online vial method.

Figure 59:
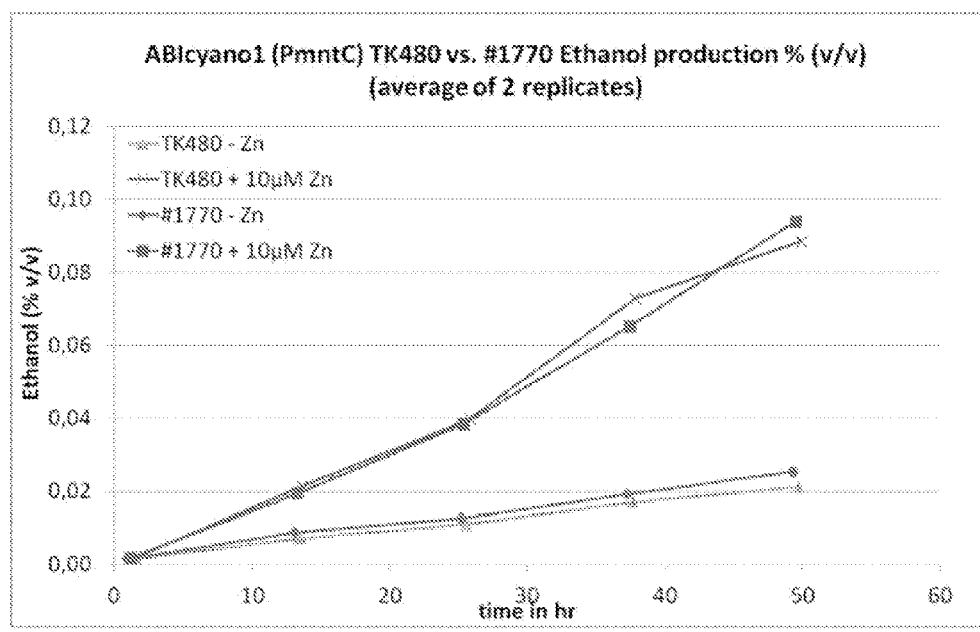
FIG. 59 depicts the ethanol production of TK480 and #1770.
Figure 60:
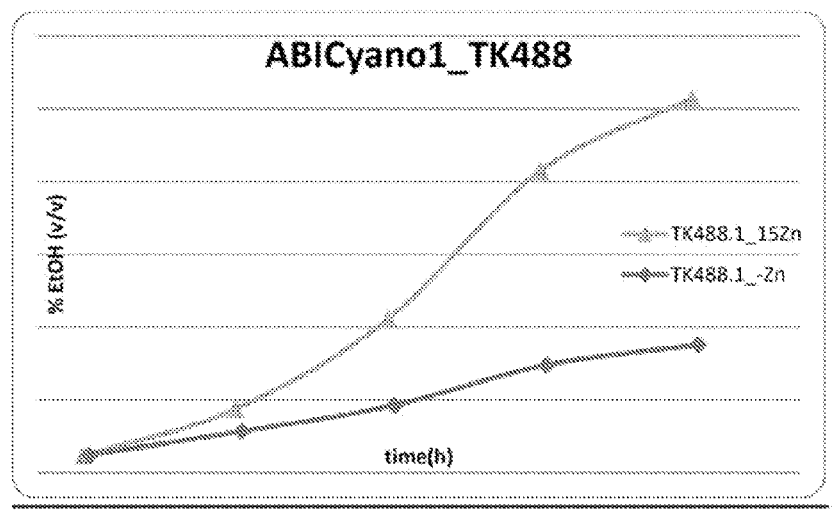
FIG. 60 depicts the ethanol production of TK488.

FIG. 59 depicts the ethanol production of Cyanobacterium sp. ABICyano1 containing the plasmid TK480 wherein a codon improved variant of a gene coding for the native PDC enzyme is under the transcriptional control of the promoter mntC (orf1071) from ABICyano1, whereas the adh with the nucleotide sequence shown in FIG. 52 (nucleotides 2390 to 3406 of SEQ ID NO: 60 whose expressed enzyme is ADH111) is under the control of a variant of the native rbc promoter from ABICyano1 with an improved ribosomal binding site (RBS). Furthermore, the ethanol production of Cyanobacterium sp. ABICyano1 containing the plasmid #1770 is depicted in FIG. 59, which is comparable to the ethanol production of Cyanobacterium sp. ABICyano1 with the plasmid TK480. This plasmid #1770 only differs from plasmid TK480 by replacing the Adh enzyme of FIG. 52 (nucleotides 2390 to 3406 of SEQ ID NO: 60) with the Synechocystis Adh enzyme. It can clearly be seen that upon addition of 10 µM Zn$^{2+}$ the ethanol production increased compared to the uninduced state with Zn$^{2+}$ and 15 µM Mn$^{2+}$ (repression by the absence of Zn$^{2+}$ and presence of Mn$^{2+}$) for both strains transformed with the plasmids #1770 and TK480, respectively. The ethanol production of Cyanobacterium sp. ABICyano1 including the plasmid TK488 after addition of 15 µM Zn$^{2+}$ is shown in FIG. 60 in comparison to the uninduced state without Zn$^{2+}$. Addition of Zn$^{2+}$ leads to a nearly 4-fold increase in ethanol production.

Figure 61:
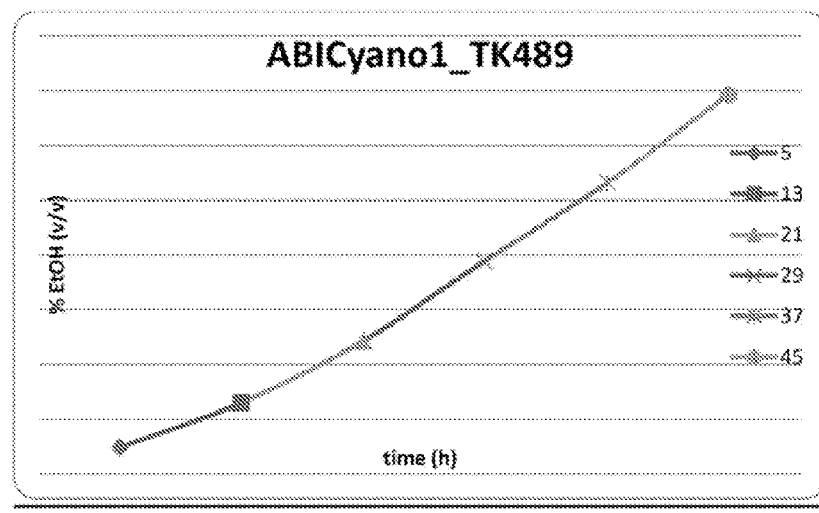
FIG. 61 depicts the ethanol production of TK489.

The ethanol production of Cyanobacterium sp. ABICyano1 containing the plasmid TK489 is depicted in FIG. 61. This graph shows a continuously rising ethanol production with increasing cultivation time in the induced state upon addition of 15 µM Zn$^{2+}$. However under uninduced conditions a high ethanol production can also be observed, which shows that this promoter is not very tight.

Figure 62:
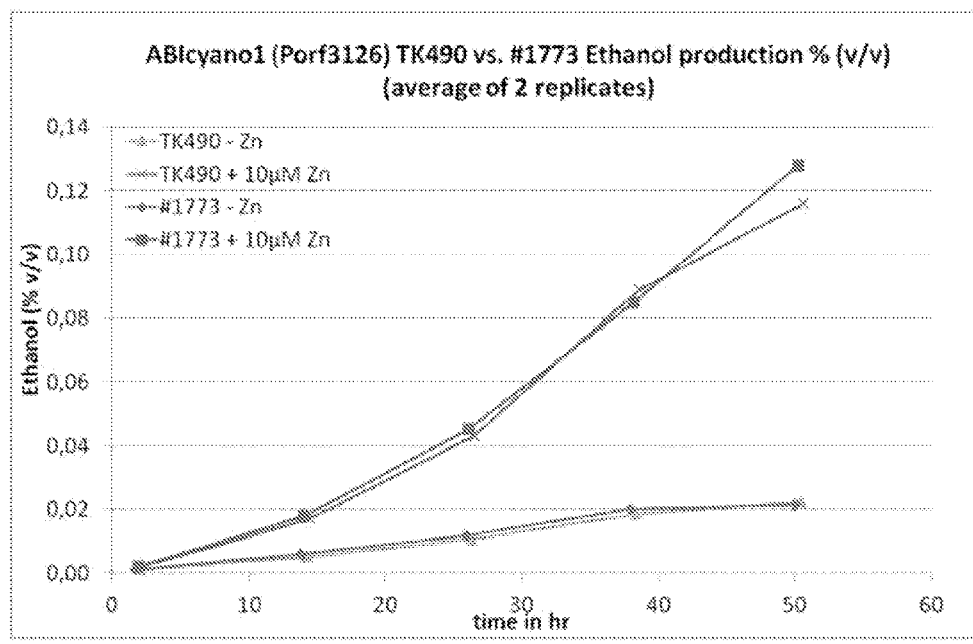
FIG. 62 depicts the ethanol production of TK490 and #1773.
Figure 63:
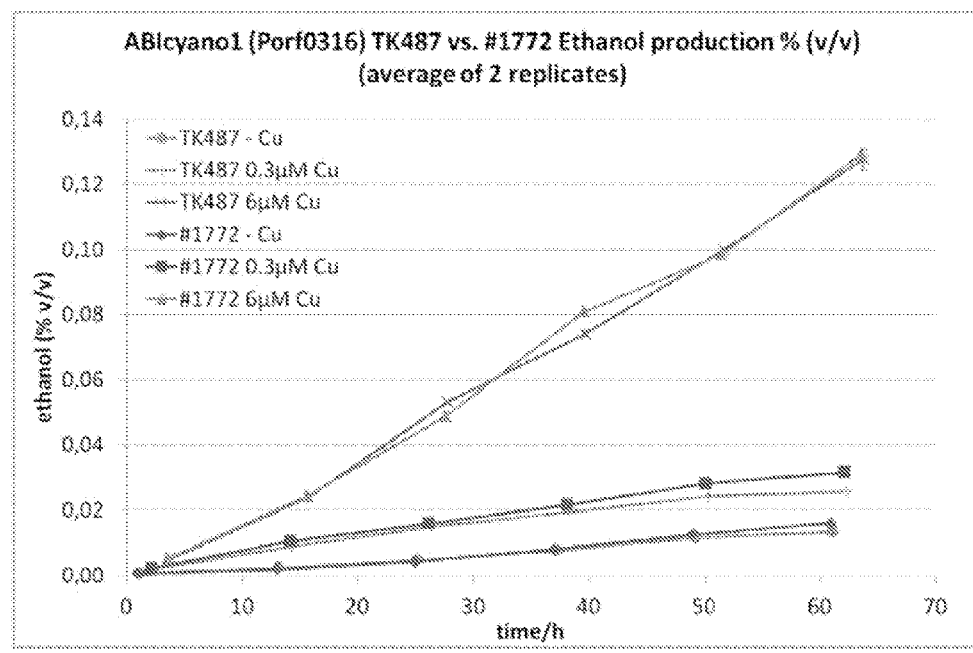
FIG. 63 depicts the ethanol production of TK487 and #1772.
Figure 64:
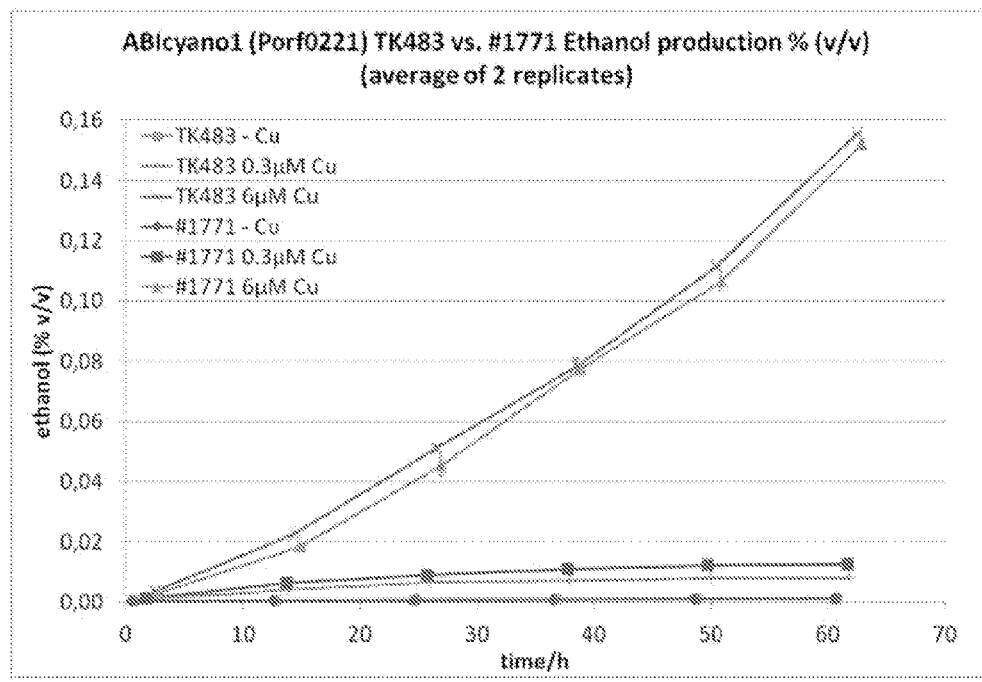
FIG. 64 depicts the ethanol production of TK483 and #1771.

FIG. 62 depicts a graph evidencing the ethanol production in ABICyano1 transformed with the plasmid TK490 including a codon improved variant of pdc gene under the transcriptional control of the promoter controlling the open reading frame (ORF) 3126 versus the ethanol production of the same strain transformed with the plasmid #1773. This plasmid differs from TK490 only in the Adh enzyme which is Synechocystis Adh for #1773 versus the adh with the sequence of FIG. 52 (nucleotides 2390 to 3406 of SEQ ID NO: 60) in TK490. Both ABICyano1 strains have a comparable ethanol production up to 40 hours of cultivation, but the ethanol production appears to be higher for #1773 after 40 hours compared to TK490. A clear increase in ethanol production can be observed upon induction by 15 µM Zn$^{2+}$ for both strains transformed with #1773 and TK490. A clear rise in ethanol production can also be seen upon induction with Cu$^{2+}$ in Cyanobacterium sp. ABICyano1 transformed with the plasmid TK487 and the plasmid #1772 (see FIG. 63). TK487 includes a codon improved variant of the Zymomonas mobilis gene coding for PDC under the transcriptional control of the promoter controlling the ORF0316 and codon improved variant of the gene coding for ADH with the nucleotide sequence shown in FIG. 52 (nucleotides 2390 to 3406 of SEQ ID NO: 60) under the transcriptional control of Prbc with an improved RBS. The plasmid #1772 contains a gene coding for Synechocystis ADH instead of the ADH with the sequence of FIG. 52 (nucleotides 2390 to 3406 of SEQ ID NO: 60). Induction with copper leads to an increase in ethanol production for both ABICyano1 strains (see FIG. 63). The ethanol production increases in comparison to the uninduced state (copper-free medium) upon addition of 0.3 µM $Cu^{2+}$ and further increases, when both strains are induced with 6 µM $Cu^{2+}$. A clear rise in ethanol production can be observed in comparison to the uninduced state (copper-free medium) by copper induction in ABICyano1 with strains containing the plasmids TK483 and #1771 upon addition of 0.3 µM and 6 µM $Cu^{2+}$ (see FIG. 64). TK483 contains a copper inducible promoter controlling ORF0221 in ABICyano1 upstream of pdc. Similar to earlier mentioned plasmids, this plasmid also includes a codon improved variant of the gene coding for ADH111 with the nucleotide sequence shown in FIG. 52 (nucleotides 2390 to 3406 of SEQ ID NO: 60) under the transcriptional control of Prbc with an improved RBS, whereas plasmid #1771 includes a gene coding for Synechocystis ADH instead of the ADH with the sequence of FIG. 52 (nucleotides 2390 to 3406 of SEQ ID NO: 60). The ethanol production of the ABICyano1 strain with the TK483 is slightly higher during a 60 hour cultivation in comparison to a strain transformed with plasmid #1771.

Figure 65:
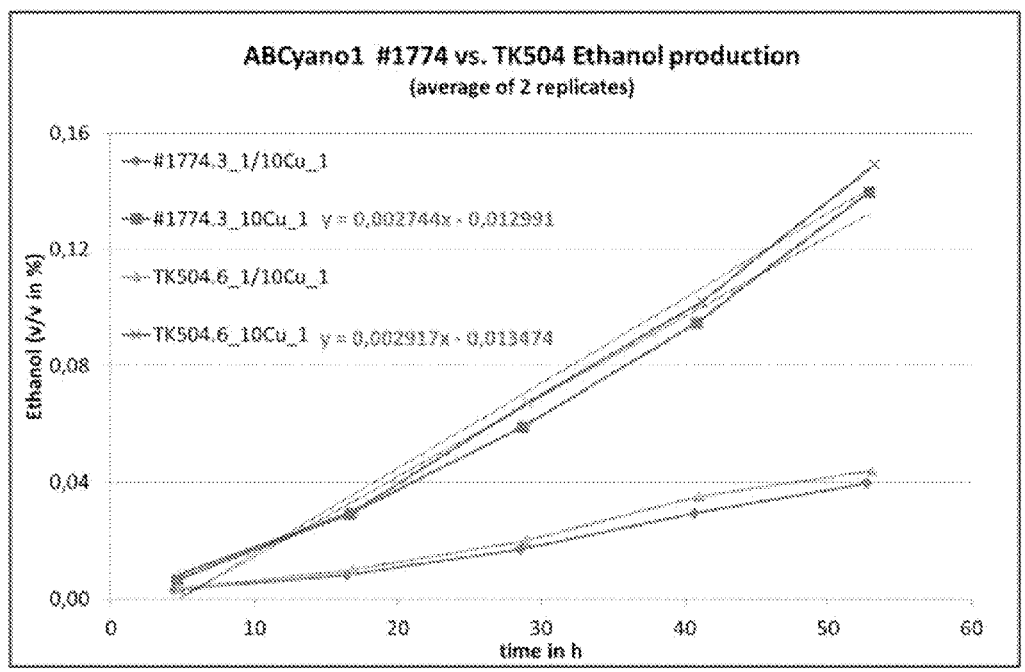
FIG. 65 depicts the ethanol production of TK504 and #1774.

FIG. 65 depicts the ethanol production of a genetically enhanced *Cyanobacterium* sp. ABICyano1 transformed with plasmid TK504 and plasmid #1774. Plasmid TK504 includes the $Cu^{2+}$ inducible promoter, which normally controls the transcription of ORF 0223. In plasmid TK504 this promoter controls the transcription of the codon improved gene coding for ZmPdc. As depicted in FIG. 65, TK504 produces ethanol at about 0.07% (vol/vol) per day. As in the above mentioned constructs TK504 ADH111 (nucleotides 2390 to 3406 of SEQ ID NO: 60) is controlled by Prbc with an improved RBS, whereas in plasmid #1774 the same promoter controls the transcription of a gene coding for SynAdh enzmye. FIG. 65 depicts ethanol production rate of ABICyano1 strains transformed with either of constructs #1774 and TK504. Strains #1774 and TK504 both comprise the endogenous copper-inducible promoter Porf0223 and were tested with (10Cu=3 µM $Cu^{2+}$) and without copper (1/10Cu=0.03 µM $Cu^{2+}$) and ethanol production was analyzed by the GC vial assay. As depicted in FIG. 65, the observed ethanol production rate of TK504 in the presence of 3 µM $Cu^{2+}$ of 0.00292% (v/v)/h over about 50 hours corresponds to about 23.1 mg(h*L) and to the production of ethanol at about 0.07% (v/v) per day as calculated from the rate of ethanol production depicted in FIG. 65 by TK504 of 0.00292% (v/v)/h multiplied by 24 hours/day. The highest productivity of TK504 in the presence of 3 µM $Cu^{2+}$ was observed in the period from about 40-52 hours of the cultivation experiment when the rate of ethanol production was about 0.00392% (v/v)/h which corresponds 31 mg/(h*L) and corresponds to the a non-naturally occurring ethanologenic ABICyano1 organism capable of producing ethanol at 0.094% (vol/vol) per day as calculated from the rate of ethanol production depicted in FIG. 65 by TK504 of 0.00392% (v/v)/h multiplied by 24 hours/day. In another embodiment, the rate of ethanol production depicted in FIG. 65 by TK504 is 0.047% (vol/vol) per twelve hours as calculated from the rate of ethanol production from hours 40 to 52 of growth of 0.00392% (v/v)/h multiplied by 12 hours.

Figure 66:
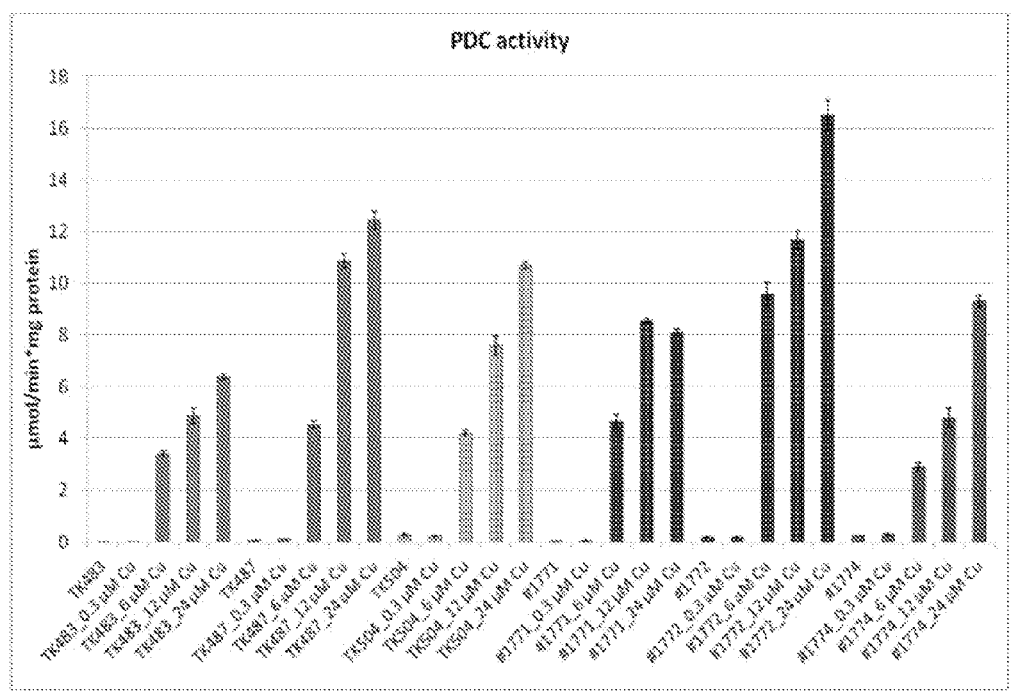
FIG. 66 depicts PDC activity for TK483, TK487, TK504, #1771, #1772, and #1774 induced with different amounts of copper.

FIG. 66 depicts the activities of PDC enzymes in the various ABICyano1 strains transformed with the plasmids TK483, TK487, TK504, #1771, #1772 and #1774 in the uninduced state and with the addition of 0.3, 6, 12 and 24 µM $Cu^{2+}$. While the activities of PDC are very low in the repressed state, increasing activities can be detected with rising concentration of $Cu^{2+}$, which clearly demonstrates that the new promoters found in ABIcyano1 can be induced by $Cu^{2+}$. Table 7 is a listing of ABICyano1 endogenous promoters inducible by a change in the concentration of $Ni^{2+}$, $Cu^{2+}$ $Co^{2+}$ and $Zn^{2+}$.

Table 8 depicts ethanol production data of ABICyano1 strains containing plasmids with genes coding for PDC under the control of endogenous inducible promoters; "n.d" means "not determined":

TABLE 7

| Gene_id | Plasmid | Homology | Inducible by |
|---|---|---|---|
| ABICyano1_orf0128 | TK493/ TK527 | hypothetical protein | $Ni^{2+}$ |
| ABICyano1_orf1486 | TK501 | putative nickel-containing superoxide dismutase | $Ni^{2+}$ |
| ABICyano1_orf3164 | TK502 | ferrochelatase | $Ni^{2+}$ |
| ABICyano1_orf3293 | TK500 | hypothetical protein L8106_16134 | $Ni^{2+}$ |
| ABICyano1_orf3621 | TK491 | hypothetical protein Cyan7822_1798 | $Ni^{2+}$ |
| ABICyano1_orf3635 | TK492 | carbohydrate-selective porin | $Ni^{2+}$ |
| ABICyano1_orf3858 | — | manganese/iron superoxide dismutase-like protein | $Ni^{2+}$ |
| ABICyano1_orf1071 | TK480 | Mn transporter | $Zn^{2+}$ |
| ABICyano1_orf1072 | TK481 | ABC transporter family protein | $Zn^{2+}$ |
| ABICyano1_orf1074 | TK482 | ABC 3 transport family | $Zn^{2+}$ |
| ABICyano1_orf1075 | TK503 | No hits found -|- KEGG: -|- CyanoBase | $Zn^{2+}$ |
| ABICyano1_orf1542 | TK489 | hypothetical protein PCC8801_4423 | $Zn^{2+}$ |
| ABICyano1_orf1823 | TK488 | RNA polymerase sigma factor | $Zn^{2+}$ |
| ABICyano1_orf1824 | — | No hits found -|- KEGG: -|- CyanoBase | $Zn^{2+}$ |
| ABICyano1_orf3126 | TK490 | Metallothionein | $Zn^{2+}$ |
| ABICyano1_orf3389 | — | HtrA2 peptidase | $Zn^{2+}$ |
| ABICyano1_orf0221 | TK483 | CopA family copper-resistance protein | $Cu^{2+}$ |
| ABICyano1_orf0222 | TK484 | copper resistance B | $Cu^{2+}$ |
| ABICyano1_orf0223 | TK504 | No hits found -|- KEGG: -|- CyanoBase | $Cu^{2+}$ |
| ABICyano1_orf0316 | TK487 | hypothetical protein CY0110_11047 | $Cu^{2+}$ |
| ABICyano1_orf3232 | TK485/ TK529 | cation-transporting ATPase | $Cu^{2+}$ |
| ABICyano1_orf3461 | TK441 | petJ | $Cu^{2+}$ depletion |
| ABICyano1_orf3749 | TK486 | conserved hypothetical protein | $Co^{2+}$ |

TABLE 8

| Gene_id | Plasmid | EtOH (v/v)/OD*d Repressed conditions | EtOH (v/v)/OD*d Induced conditions |
|---|---|---|---|
| ABICyano1_orf1486 | TK501 | 0.021 | 0.024 |
| ABICyano1_orf3164 | TK502 | 0.0024 | 0.0029 |
| ABICyano1_orf3293 | TK500 | 0.0026 | 0.0035 |
| ABICyano1_orf3621 | TK491 | 0.003 | 0.007 |
| ABICyano1_orf3635 | TK492 | 0.018 | 0.017 |
| ABICyano1_orf3858 | — | n.d. | n.d. |
| ABICyano1_orf1071 | TK480 | 0.004 | 0.025 |
| ABICyano1_orf1542 | TK489 | 0.015 | 0.021 |
| ABICyano1_orf1823 | TK488 | 0.003 | 0.011 |
| ABICyano1_orf1824 | — | n.d. | n.d. |
| ABICyano1_orf3126 | TK490 | 0.007 | 0.02 |
| ABICyano1_orf3389 | — | n.d. | n.d. |
| ABICyano1_orf0221 | TK483 | 0.001 | 0.023 |
| ABICyano1_orf0223 | TK504 | 0.007 | 0.025 |
| ABICyano1_orf0316 | TK487 | 0.003 | 0.021 |
| ABICyano1_orf3461 | TK441 | 0.0001 | 0.017 |
| ABICyano1_orf3749 | TK486 | 0.001 | 0.001 |

In an embodiment, the plasmids TK411 to TK490 contain the inducible promoters from ABICyano1 listed in the table 7 and/or 8 controlling the transcription of codon improved variant genes coding for *Zymomonas mobilis* Pdc enzyme, in the following called ZmPdc. These plasmids further harbor different codon improved genes coding either for *Synechocystis* ADH or ADH with the nucleotide sequence shown in FIG. 52 (nucleotides 2390 to 3406 of SEQ ID NO: 60), which are all controlled by constitutive promoters, PrpsL or Prbc* from ABICyano1.

The plasmid map of plasmid TK441 is shown in FIG. 15 and its nucleic acid sequence is depicted in SEQ ID NO: 50. The gene coding for ZmPdc is under the transcriptional control of the native PpetJ and a codon improved gene of SynAdh enzyme is controlled by the native PrpsL promoter from ABICyano1. FIG. 52 shows the plasmid map of the plasmid TK480 including the native Pmntc promoter of ABICyano1 controlling the gene coding for ZmPdc and Prbc with an improved RBS controlling the codon improved gene coding for Adh enzyme. FIG. 53 depicts the plasmid map of TK483. This plasmid contains the $Cu^{2+}$ inducible promoter from ORF0221 of *Cyanobacterium* sp. ABICyano1 coding for a CopA family copper-resistance protein. The adh gene in TK483 is under control of Prbc* with an improved RBS. FIG. 54 depicts a plasmid map of TK487. This plasmid includes the $Cu^{2+}$ inducible promoter from ORF0361 of ABICyano1 directly upstream of ZmPdc and Prbc* with an improved RBS controlling the transcription of a codon improved gene coding for the ADH enzyme with the nucleotide sequence shown in FIG. 52 (nucleotides 2390 to 3406 of SEQ ID NO: 60 whose expressed enzyme is ADH111). The plasmid map of TK488 is depicted in FIG. 55. This construct harbors the native $Zn^{2+}$ inducible PsigH from ABICyano1 for transcriptional control of a codon improved ZmPdc gene and Prbc* for the transcriptional control of the gene coding for ADH with the nucleotide sequence shown in FIG. 52 (nucleotides 2390 to 3406 of SEQ ID NO: 60). The gene encoding ZmPdc is controlled by the $Zn^{2+}$ inducible promoter from the ORF 1542 from *Cyanobacterium* sp. ABICyano1 in the construct TK489 (FIG. 56). The plasmid map of TK490 is depicted in FIG. 57. In this plasmid the gene coding for ZmPdc is controlled by the $Zn^{2+}$ inducible promoter which controls the transcription of the ORF3126 in *Cyanobacterium* ABICyano1. The map of plasmid TK504 is depicted in FIG. 58. In TK504 the pdc gene is controlled by the $Cu^{2+}$ inducible Porf0223 and the adh gene FIG. 52 (nucleotides 2390 to 3406 of SEQ ID NO: 60) by Prbc* with an improved RBS.

Copper-Inducible Strains and Zinc-Inducible Strains

In an embodiment, non-naturally occurring ABICyano1 organisms containing p6.8 derived vectors with ethanologenic cassettes containing copper-inducible promoters are disclosed that exhibit stable ethanol production for prolonged periods of time. In an embodiment, copper-inducible ABICyano1 ethanologenic strains containing an exogenous adh/pdc cassette enable high and stable PDC activity over time (in contrast to using a PnirA promoter) are disclosed herein.

Figure 67:
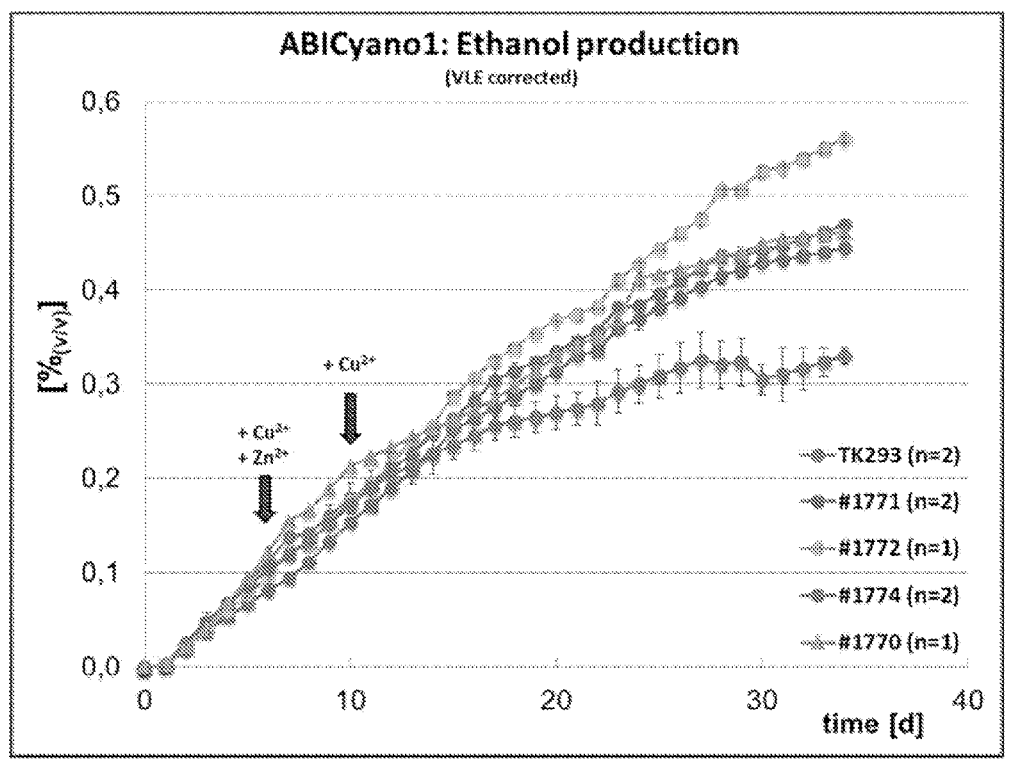
FIG. 67 depicts copper-inducible strains such as #1771 ($P_{orf0221}$), #1772 ($P_{orf0316}$) and #1774 ($P_{orf0223}$) as well as a zinc-inducible strain #1770 ($P_{mntC}$) exhibit a higher ethanol productivity than a nitrate inducible strain TK293 uses the nirA promoter.
Figure 68:
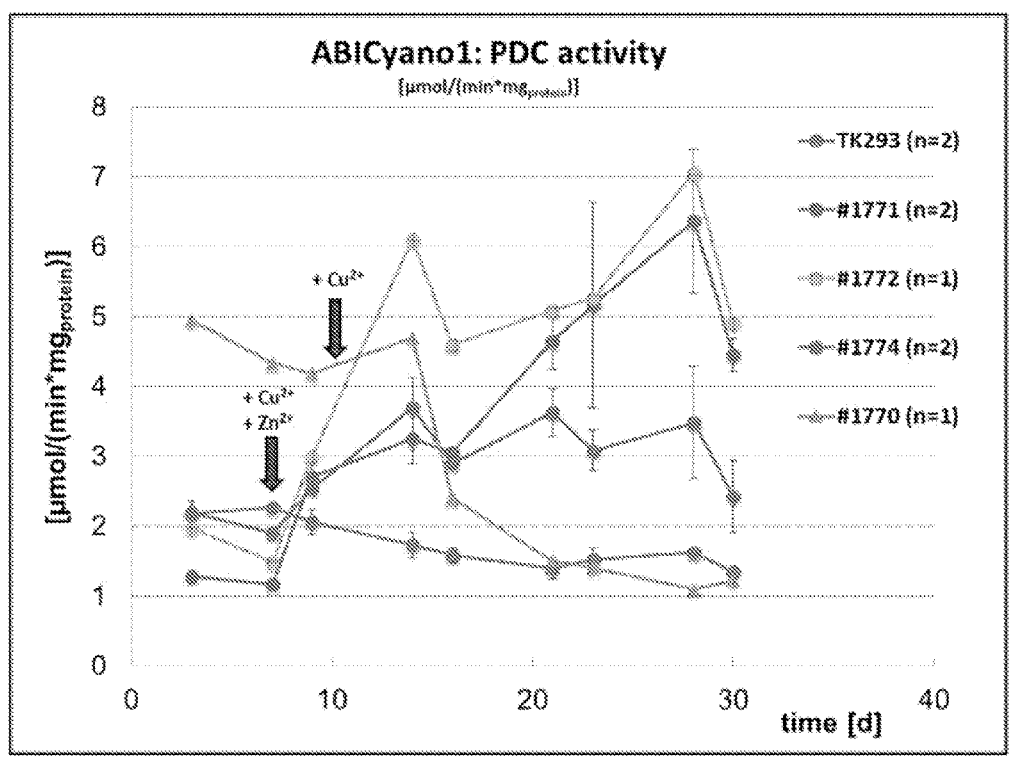
FIG. 68 depicts that the PDC activity of strains #1770, #1771, #1772 and #1774 were greater than TK293.

In another embodiment, non-naturally occurring ABICyano1 organisms containing p6.8 derived vectors such as a #1770 plasmid containing a zinc inducible PmntC promoter linked to the pdc/adh cassette are disclosed herein. As depicted in FIG. 67, copper-inducible strains such as #1771 ($P_{orf0221}$), #1772 ($P_{orf0316}$) and #1774 ($P_{orf0223}$) as well as a zinc-inducible strain #1770 ($P_{mntC}$) exhibit a higher ethanol productivity than a nitrate inducible strain TK293 that uses a PnirA promoter. Induction protocols use initial $Cu^{2+}$ addition and also further $Cu^{2+}$ additions. As depicted in FIG. 68, the PDC activity of strains #1770, #1771, #1772 and #1774 were greater than TK293. The strains depicted in FIGS. 67 and 68 were cultivated in a vertical photobioreactor (vPBR) at 200 $\mu E*m^{-2}*s^{-1}$ in a 12 h/12 day/night cycle.

As depicted in FIG. 162, the ethanologenic acitivity of a non-naturally occurring ethanologenic ABICyano1 strain comprising plasmid #1772 with the endogenous copper-inducible promoter Porf0316 was tested with 20×Cu (6 µM $Cu^{2+}$) at a start GD of 2 either grown with ammonia/urea (2 mM each) or nitrate (BG11 recipe) as the sole nitrogen source. Ethanol production was analyzed by GC vial assay. The observed ethanol production rate of 0.00409% (v/v)/h over about 40 hours corresponds to about 32.3 mg/(h*L). The greatest productivity measured was observed in the period from about 5-25 hours of the cultivation experiment having a rate of about 0.00440% (v/v)/h which corresponds to 34.8 mg/(h*L).

Figure 69:
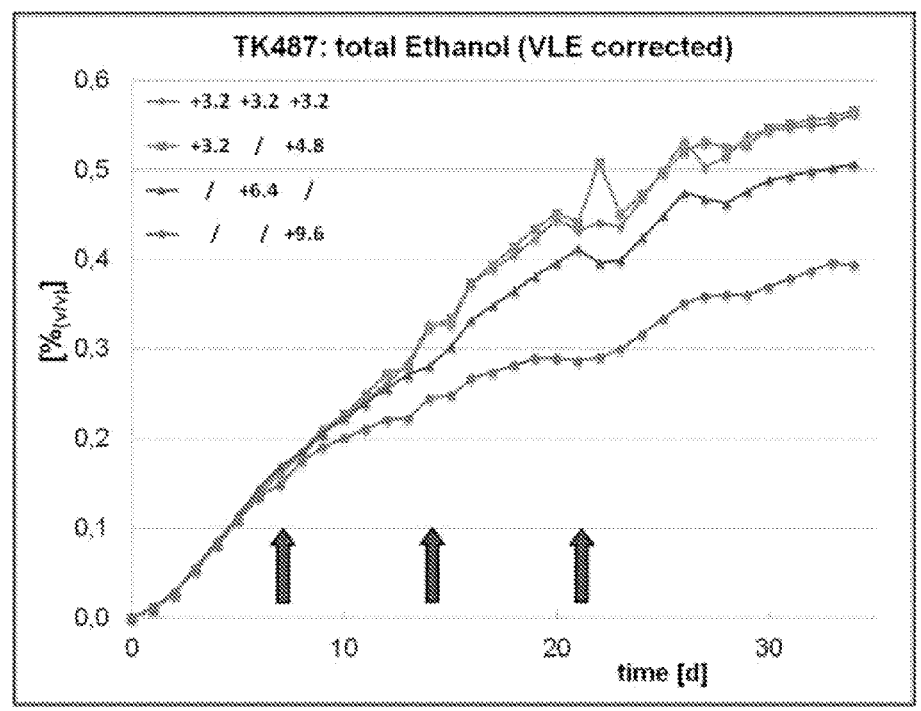
FIG. 69 depicts initial induction with 1.6 µM $Cu^{2+}$ (which is about five times the $Cu^{2+}$ concentration of BG11) followed by further copper additions different in all four treatments of TK487 for ethanol production.
Figure 70:
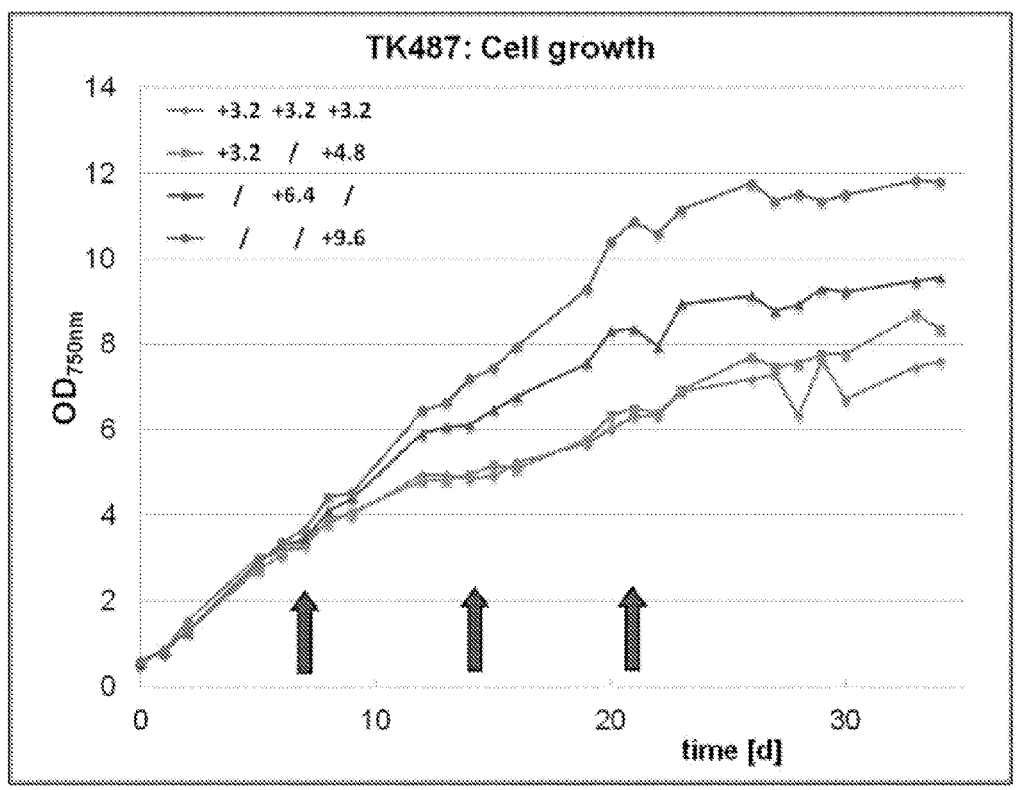
FIG. 70 depicts depicts initial induction with 1.6 µM $Cu^{2+}$ (which is about five times the $Cu^{2+}$ concentration of BG11) followed by further copper additions different in all four treatments of TK487 for cell growth.
Figure 71:
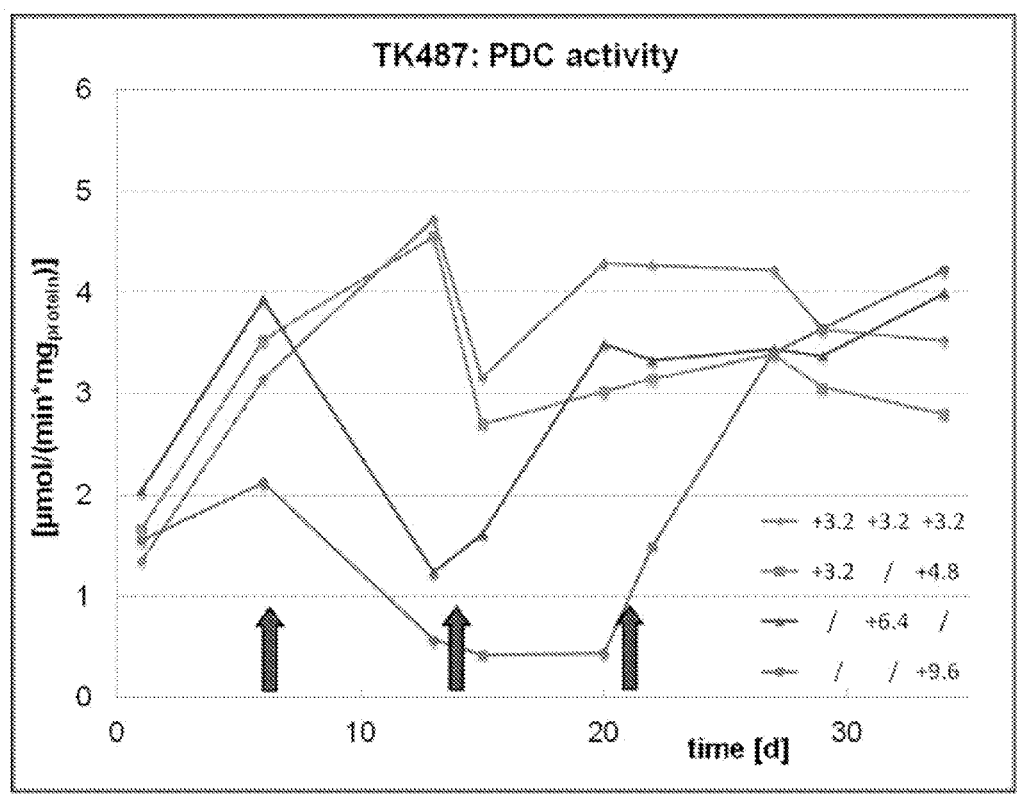
FIG. 71 depicts PDC activity in TK487 for the cultivation depicted in FIGS. 70 and 71.
Figure 72:
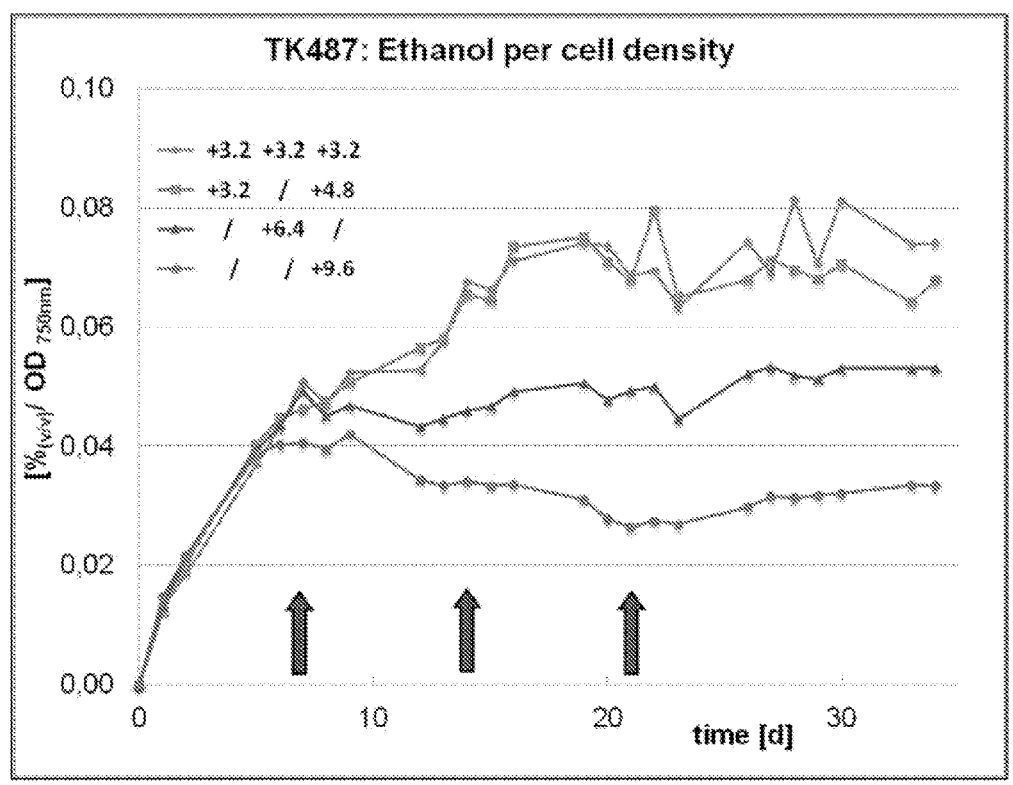
FIG. 72 depicts ethanol per cell density of induced TK487 for the cultivation depicted in FIGS. 70 and 71.
Figure 73:
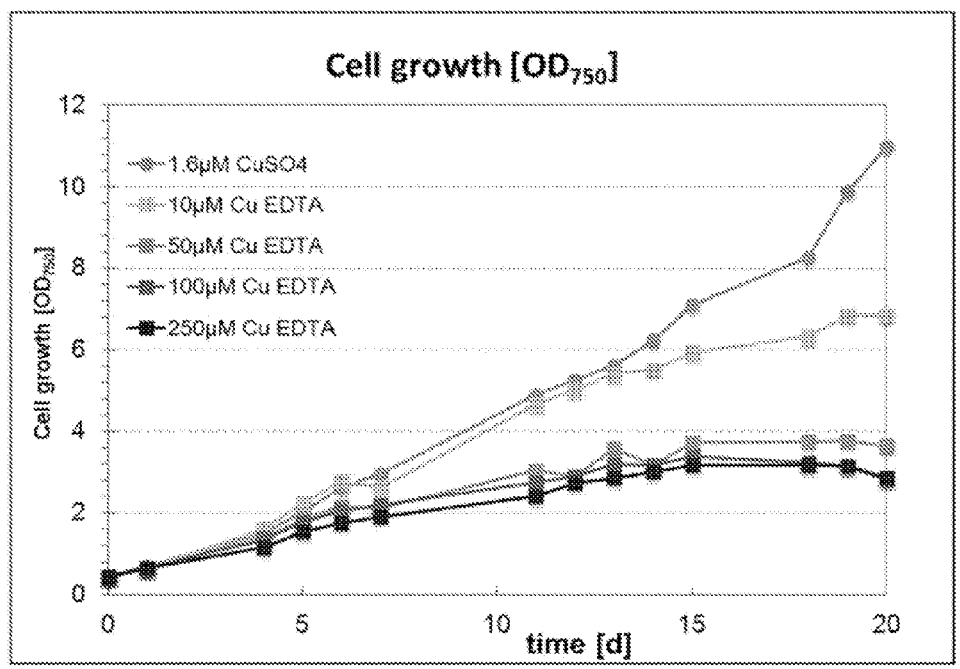
FIG. 73 depicts the effect on cell growth of releasing copper into solution over a prolonged period of time and at various concentrations of copper to a TK487 strain.
Figure 74:
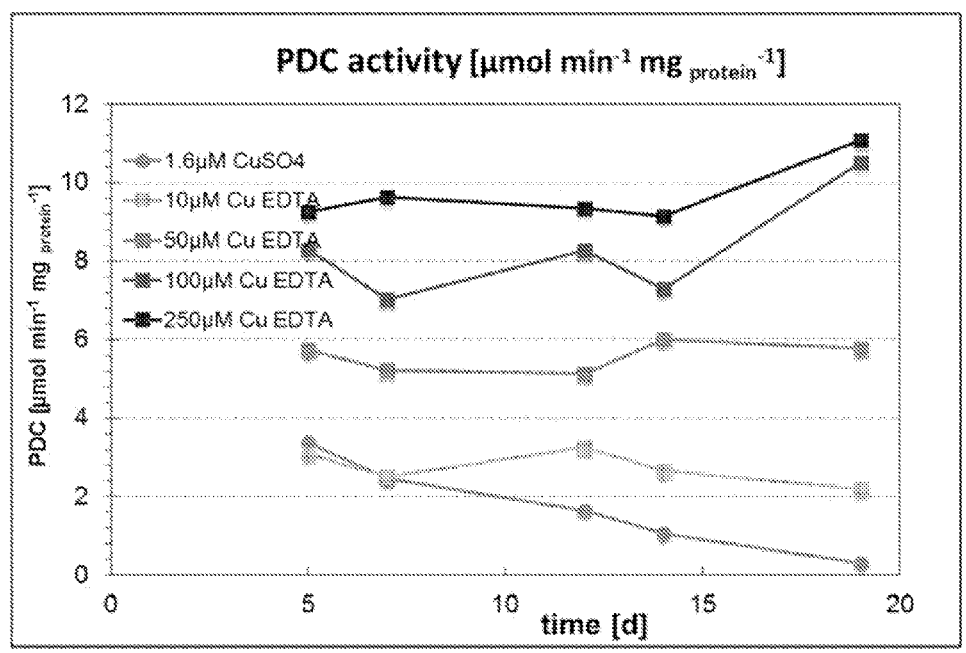
FIG. 74 depicts the effect on PDC activity of releasing copper into solution over a prolonged period of time and at various concentrations of copper to a TK487 strain.
Figure 75:
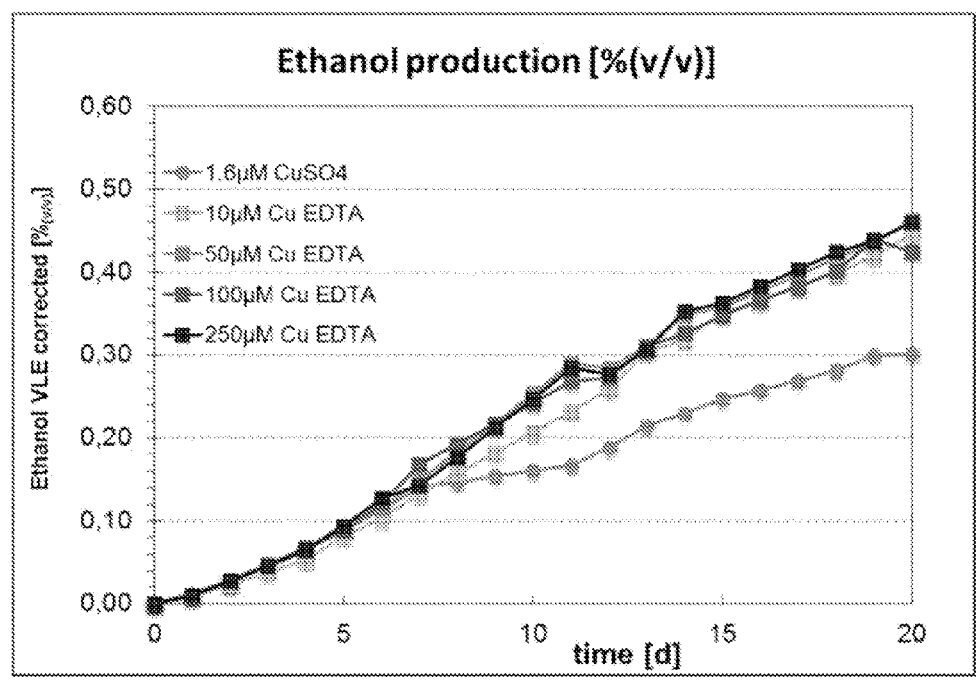
FIG. 75 depicts the effect on ethanol production of releasing copper into solution over a prolonged period of time and at various concentrations of copper to a TK487 strain.
Figure 76:
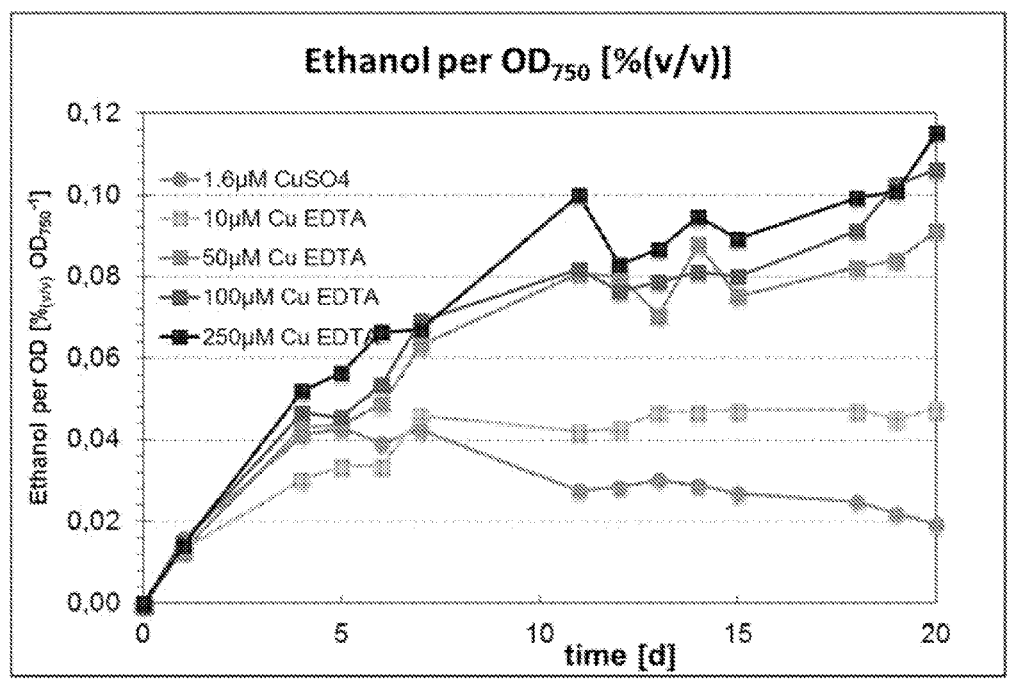
FIG. 76 depicts the effect on ethanol production per $OD_{750}$ of releasing copper into solution over a prolonged period of time and at various concentrations of copper to a TK487 strain.

Initial induction with 1.6 µM $Cu^{2+}$ (which is about five times the $Cu^{2+}$ concentration of BG11) in all four treatments of TK487 for ethanol production is depicted in FIG. 69 and for cell growth of TK487, in FIG. 70. TK487 is identical to #1772 ($P_{orf0316}$), except for a different adh gene. PDC activity in TK487 is depicted in FIG. 71. Ethanol per cell density of induced TK487 is depicted in FIG. 72. In an embodiment, weekly and bi-weekly (day 7 and 21) copper addition results in the highest tested ethanol production and lowest biomass accumulation.

FIGS. 73 through 76 respectively depict the effect on cell growth, PDC activity, ethanol production, and ethanol production per $OD_{750}$ of releasing copper into solution over a prolonged period of time and at various concentrations of copper to a TK487 strain. In an embodiment, the PDC activity and ethanol production per $OD_{750}$ of TK487 increase with increasing amounts of copper chelated Cu(II) disodium EDTA in the solution and cell growth is inversely related to increasing amounts of copper chelated Cu(II) disodium EDTA in the solution. Not being limited by theory, in contrast to the treatment with free copper, the use of Cu(H) disodium EDTA enables a stable PDC expression and activity without further additions of copper during the course of cultivation.

Figure 77:
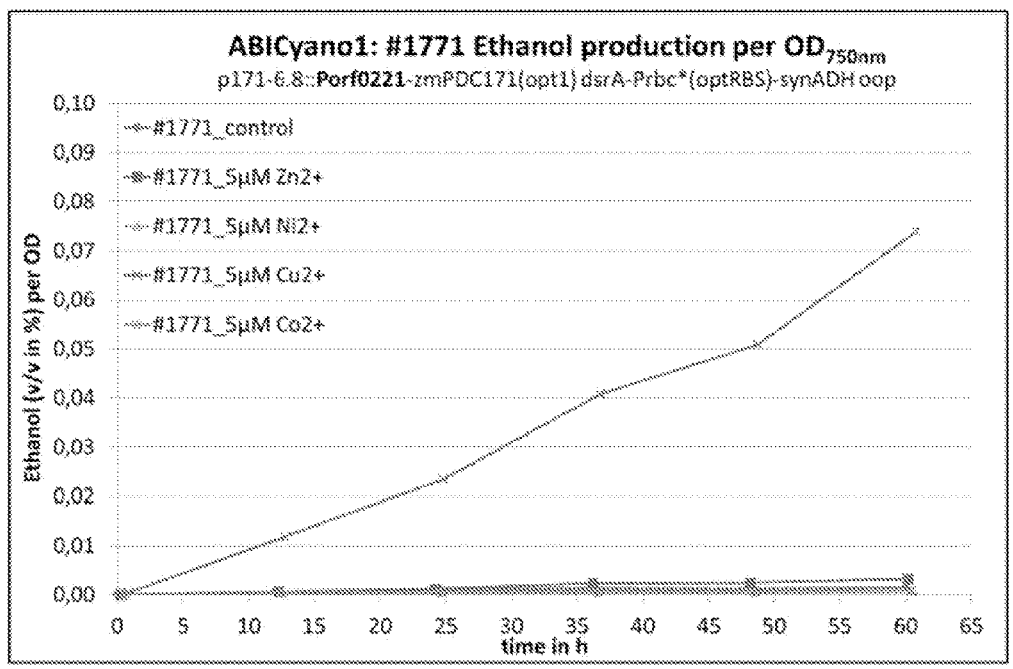
FIG. 77 depicts the ethanol production over time of an ABICyano1 strain #1771 incubated with different bivalent metal-ions to test the specificity for copper.
Figure 78:
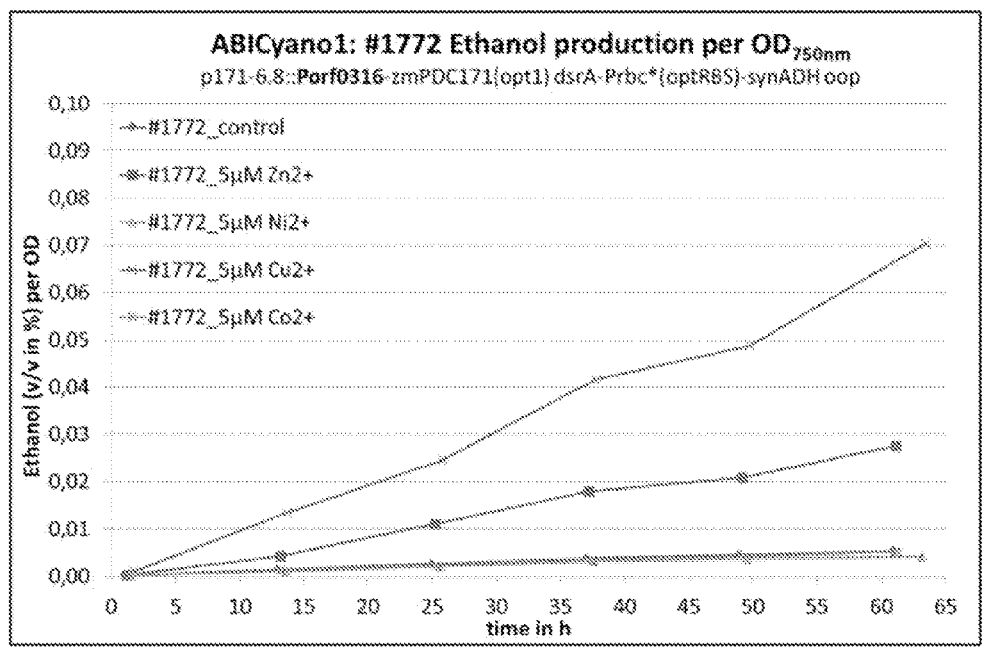
FIG. 78 depicts the ethanol production over time of an ABICyano1 strain #1772 incubated with different bivalent metal-ions to test the specificity for copper.
Figure 79:
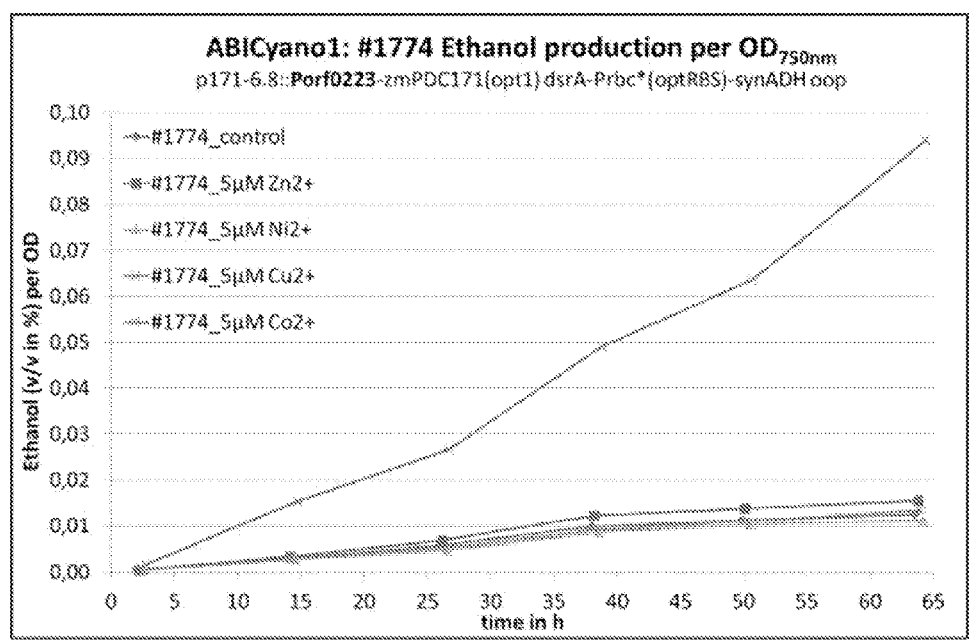
FIG. 79 depicts the ethanol production over time of an ABICyano1 strain #1774 incubated with different bivalent metal-ions to test the specificity for copper.

FIGS. 77 through 79 depict cross-reactivity of ABICyano1 endogenous copper-inducible promoters $P_{orf0221}$, $P_{orf0316}$, and $P_{orf0223}$ in the presence of other divalent metal ions. FIG. 77 depicts the ethanol production over time of an ABICyano1 strain #1771 that has a plasmid containing an ethanologenic cassette encoding for a PDC enzyme that is operably linked to promoter $P_{orf0221}$ while synADH is operably linked to Prbc* (optRBS). As depicted in FIG. 77, $P_{orf0221}$ is induced by copper ion and not by zinc, nickel or cobalt ions. FIG. 78 depicts the ethanol production over time of an ABICyano1 strain #1772 that has a plasmid containing an ethanologenic cassette encoding for a PDC enzyme that is operably linked to promoter $P_{orf0316}$ while synADH is operably linked to Prbc* (optRBS). As depicted in FIG. 78, $P_{orf0316}$ is induced by copper ion and to a lesser extent by zinc ion, but not by nickel or cobalt ions. FIG. 79 depicts the ethanol production over time of an ABICyano1 strain #1774 that has a plasmid containing an ethanologenic cassette encoding for a PDC enzyme that is operably linked to promoter while synADH is operably linked to Prbc*(optRBS). As depicted in FIG. 79, $P_{orf0223}$ is induced by copper ion and not by zinc, nickel or cobalt ions. Thus, in an embodiment, endogenous copper inducible promoters from ABICyano1 exhibit a high selectivity for copper and can be used to control expression of operably linked genes in ABICyano1 by the addition of copper to the medium.

Figure 80:
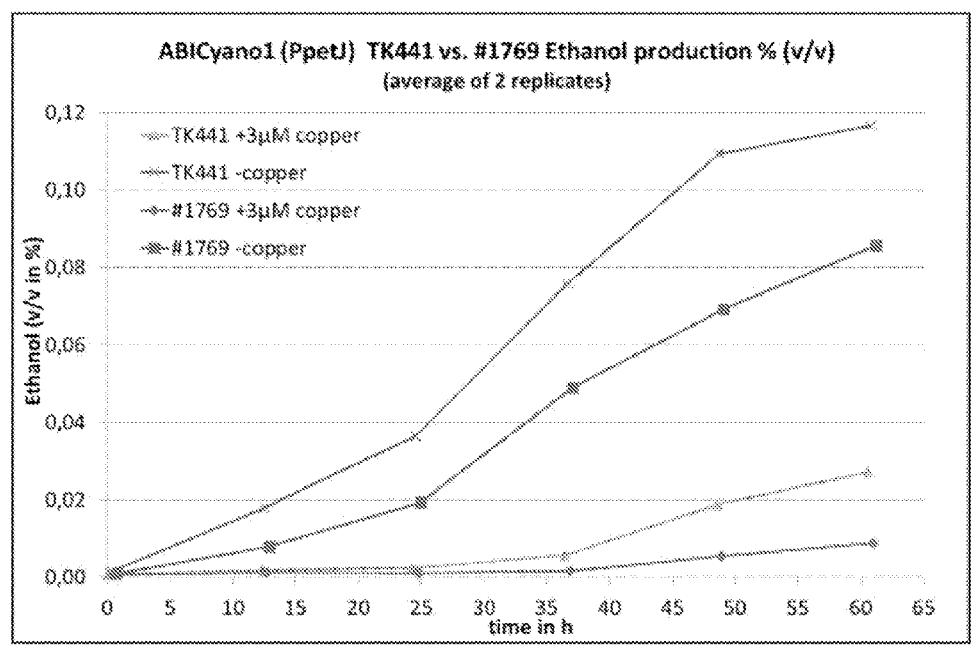
FIG. 80 depicts both ethanologenic ABICyano1 strains TK441 and #1769 producing ethanol in growth media substantially lacking copper ion while producing less ethanol in the presence of 3 µM copper ion.

FIG. 80 depicts the production of ethanol by ethanologenic ABICyano1 strains TK441 and #1769 that contain the promoter PpetJ. Promoter $P_{petJ}$ is inducible by the deprivation of copper. ABICyano1 strains TK441 and #1769 contain an ethanologenic cassette that encodes for ADH and PDC enzymes whose expression is operably linked to $P_{petJ}$. As depicted in FIG. 80, both ethanologenic ABICyano1 strains TK441 and #1769 produce ethanol in growth media substantially lacking copper ion while producing less ethanol in the presence of 3 µM copper ion. Thus, in an embodiment, promoter $P_{petJ}$ operably linked to an ethanologenic cassette in a non-naturally occurring ABICyano1 organism can be used to control the production of ethanol.

Table 9 depicts the ethanol production data for various ABICyano1 strains. The third column shows the ethanol production rate as determined by a GC vial online assay. The fourth to sixth column depicts the ethanol production determined for 0.5 L Crison PBR, and for vPBR with different illumination intensities for a period of cultivation of 14 days or 21 days, respectively. These ethanol production data were determined with GC single measurements. The term "vPBR" indicates "vertical photobioreactors". The following procedure describes the standard lab conditions under which a 1.2 L vPBR is operating as well as the necessary parts, ports, etc. to construct this 1.2 L vPBR. Table 9 depicts a list of plasmids for used for transformation of ABICyano1 with ethanologenic cassettes and also depicts ethanol production in ABICyano1 host cells created thereby.

TABLE 9

Figure 118:
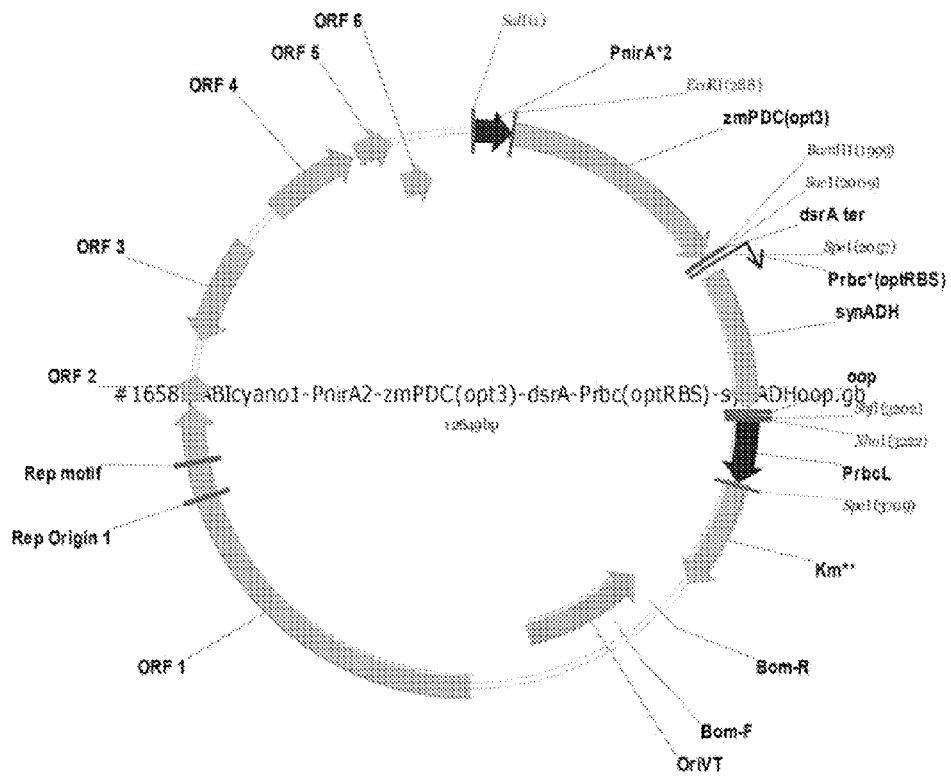
FIG. 118 depicts a plasmid map of and sequence annotation of plasmid #1658 (pABIcyano1-PnirA2-zmPDC(opt3)-dsrA-Prbc(optRBS)-synADHoop).
Figure 119:
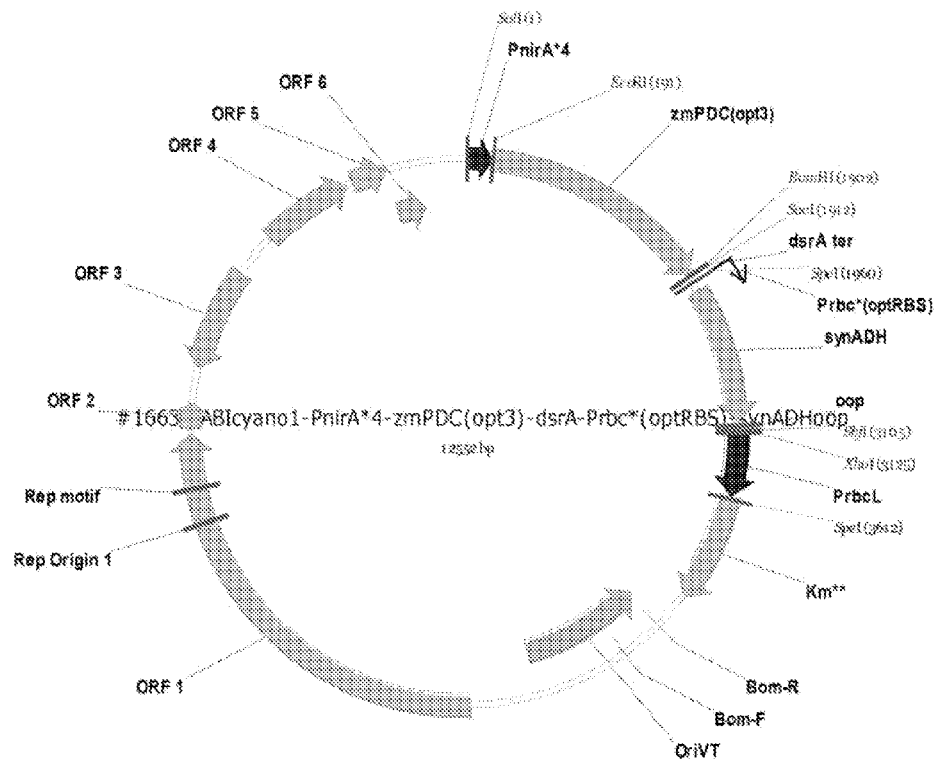
FIG. 119 depicts a plasmid map of and sequence annotation of plasmid #1663 (pABIcyano1-PnirA*4-zmaPDC(opt3)-dsrA-Prbc*(optRBS)-synADHoop).
Figure 120:
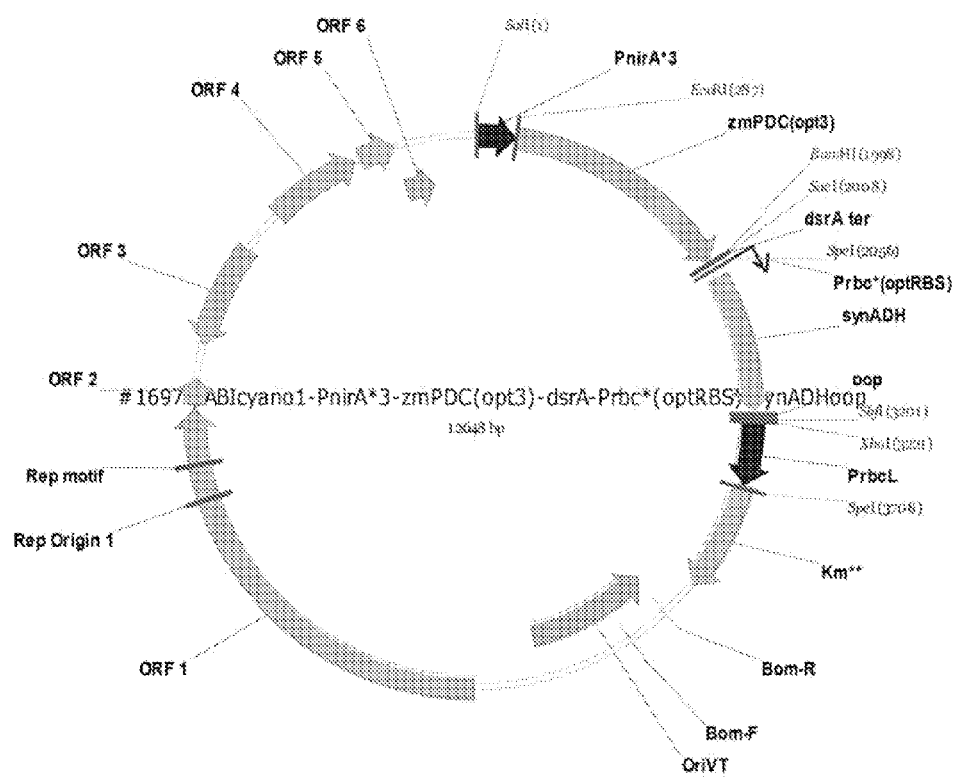

| Plasmid | Construct | EtOH rate GC vial assay (120 µE m−2 s−1) [% (v/v) EtOH/d * OD$_{avg}$.] over ca. 48 h | EtOH rate 0.5 L Crison PBR (2 × 450 µE m$^{−2}$ s$^{−1}$) [% (v/v) EtOH/d] over 14 days | EtOH rate 1.2 L vPBR (125 µE m−2 s−1) [% (v/v) EtOH/d] over 14/21 days | EtOH rate 1.2 L vPBR (230 µE m−2 s−1 [% (v/v EtOH/d] over 14/ 21 days |
|---|---|---|---|---|---|
| #1578/ #1646 #1646 FIG. 125 (SEQ ID NO: 75) | pABICyano1- 6.8::PnirAzmPdc (opt3)-dsrA- Prbc*(optRBS)- synADH (#1578)\oop or ADH111 (#1646) | 0.0326 | 0.0446 | 0.0149/0.0130 | 0.0196/0.0176 |
| #1658/ #1684 #1658 FIG. 118 (SEQ ID NO: 72) | pABICyano1- 6.8::PnirA*2 zmPdc(opt3)- dsrA- Prbc*(optRBS)- synADH (#1658)\oop or ADH111(#1684) | 0.0346 | 0.0493 | 0.0161/0.0145 | n.d. |
| #1663 #1663 FIG. 119 (SEQ ID NO: 73) | pABICyano1- 6.8::PnirA*4 zmPdc(opt3)- dsrA- Prbc*(optRBS)- synADH\oop | 0.0366 | 0.0443 | 0.0150/0.0120 | n.d. |
| #1697/ #1665 #1697 FIG. 120 (SEQ ID NO: 74) | pABICyano1- 6.8::PnirA*3 zmPdc(opt3)- dsrA- Prbc*(optRBS)- synADH (#1697)\oop or ADH111 (#1665) | 0.0339 | 0.0377 | 0.0139/0.0117 | n.d. |
| TK480/# 1770 | pABICyano1- 6.8::PmntC zmPDC(opt1)dsrA- Prbc*(optRBS)- ADH111 (TK480) or Synechocystis ADH (#1770) | 0.0216 | n.d. | 0.0097/0.0105 | 0.0170/0.0143 |
| TK483/# 1771 | pABICyano1- 6.8::Porf0221- zmPDC(opt1)dsrA- Prbc*(optRBS)- ADH111 (TK483) or Synechocystis ADH (#1771) | 0.0305 | 0.0286 | 0.0104/0.0115 | 0.0166/0.0140 |

TABLE 9-continued

| Plasmid | Construct | EtOH rate GC vial assay (120 µE m−2 s−1) [% (v/v) EtOH/d * OD$_{avg}$] over ca. 48 h | EtOH rate 0.5 L Crison PBR (2 × 450 µE m$^{-2}$ s$^{-1}$) [% (v/v) EtOH/d] over 14 days | EtOH rate 1.2 L vPBR (125 µE m−2 s−1) [% (v/v) EtOH/d] over 14/21 days | EtOH rate 1.2 L vPBR (230 µE m−2 s−1 [% (v/v EtOH/d] over 14/21 days |
|---|---|---|---|---|---|
| TK487/# 1772 | pABICyano1-6.8::Porf0316-zmPDC(opt1)dsrA-Prbc*(optRBS)-ADH111 (TK487) or Synechocystis ADH (#1772) | 0.0323 | 0.0300 | 0.0150/0.0120 | 0.0205/0.0161 |
| TK490/# 1773 | pABICyano1-6.8::Porf3126-zmPDC(opt1)dsrA-Prbc*(optRBS)-ADH111 (TK490) or Synechocystis ADH (#1773) | 0.0329 | n.d. | n.d. | n.d. |
| TK504/# 1774 | pABICyano1-6.8::Porf0223-zmPDC(opt1)dsrA-Prbc*(optRBS)-ADH111 (TK504) or Synechocystis ADH (#1774) | 0.0333 | 0.0307 | n.d. | 0.0172/0.0148 |

In another embodiment, genetically enhanced *Cyanobacterium* sp. ABICyano1 strains including extrachromosomal plasmids all containing a pdc gene under the transcriptional control of either the native nirA promoter or modified variants thereof were cultured in 0.5 L photobioreactors. These strains included the plasmids #1606, #1629 and #1636. FIG. 28 depicts the ethanol production normalized to the growth (OD$_{750nm}$) determined by GC single measurements for ABICyano1 strains transformed with the plasmids #1606 (pdc gene under the control of the native PnirA), plasmid #1629 (pdc gene under the control of a modified variant of PnirA with changes in the RBS) and plasmid #1636 (pdc gene under the control of a modified variant of PnirA With changes in the operator sequence and the TATA box) for a period of time of at least 20 days after induction was realized by transition of the pre-culture to usual mBG11 medium (containing nitrate for induction) at the beginning of the cultivation experiment. The graph depicts that the normalized ethanol production is higher for the strains including the plasmids with the modified promoters. FIGS. 29 and 30 depict the specific activity of PDC and ADH during the course of the above mentioned cultivation. As depicted in FIGS. 29 and 30 the inducible modified nirA promoter variants PnirA*2 (#1629) and PnirA*3 (#1636) result in a higher activity of PDC enzyme compared to the native promoter (#1606).

FIG. 31 depicts the ethanol production normalized to the growth (OD$_{750nm}$) determined by the GC single measurement method for ABICyano1 strains transformed with the plasmids #1606 (pdc gene under the control of the native PnirA), plasmid #1631 (pdc gene under the control of a modified PcorT with modifications in the TATA box) and plasmid #1632 (pdc gene under the control of a modified PcorT with modifications in the TATA box and the RBS) for a period of time of at least 20 days cultured in 0.5 L photobioreactors. The ethanol production of the strain transformed with the plasmid containing the native PnirA with pdc gene is comparable to the ethanol production of the strain containing the plasmid with the pdc gene controlled by the modified corT promoter variants PcorT*3 (#1632) with modifications in the TATA box and RBS, whereas the ethanol production of the strain containing the plasmid with PcorT with modifications only in the TATA box PcorT*2 (#1631) exhibits a lower ethanol production rate, especially in the time period starting from the tenth day of cultivation on.

FIGS. 32 and 33 depict the specific activity of PDC enzyme and ADH enzyme during the course of the above mentioned cultivation. The strains with the native PnirA as well as the PcorT*3 comprising modifications in the TATA box and the RBS show higher reactivity of PDC enzyme than the other strain.

FIGS. 40 to 42 depict the ethanol production rates of the ABICyano1 strains transformed with the plasmids #1635, #1639 and #1640 including the native PsmtA promoter from *Synechococcus* PCC 7002 as well as modified versions of PsmtA. It can clearly be seen that all promoters are repressed in the absence of $Zn^{2+}$ and can be induced upon addition of $Zn^{2+}$.

Figure 81:
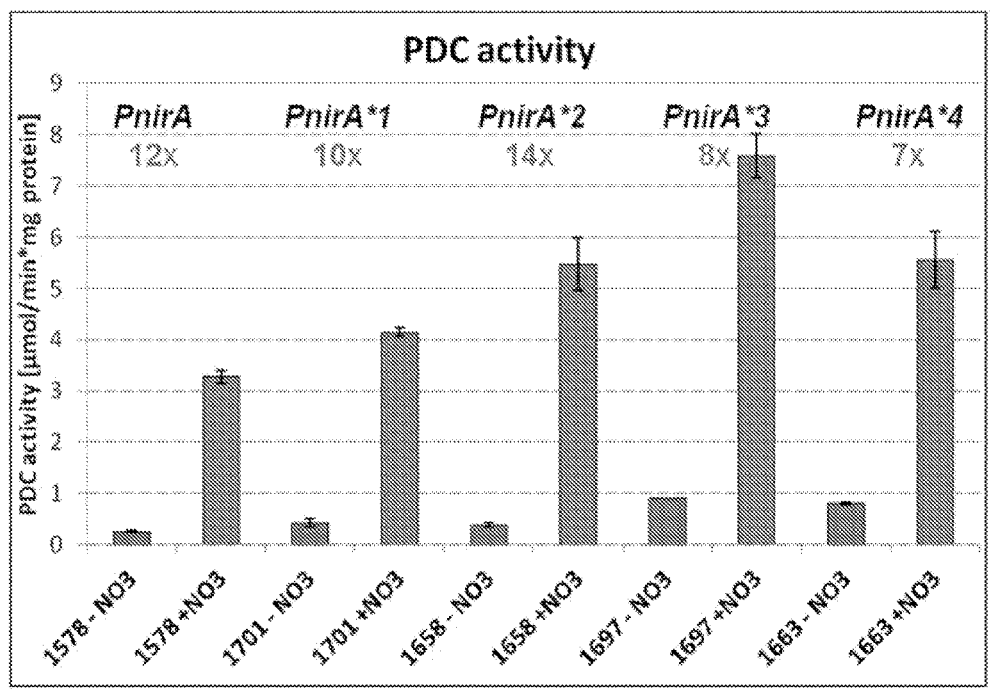
FIG. 81 depicts the activity of PDC in the uninduced state and after 72 hours of induction for ABICyano1 strains transformed with the plasmids #1578, #1701, #1658, #1697 and #1663.

FIG. 81 depicts the activity of Pdc enzyme in the uninduced state and after 72 hours of induction for ABICyano1 strains transformed with the plasmids #1578, #1701, #1658, #1697 and #1663, including an unmodified endogenous nirA promoter (plasmid #1578), and four different modified nirA promoter variants PnirA*1 (plasmid #1701), PnirA*2 (plasmid #1658), PnirA*3 (plasmid #1697) and PnirA*4 (plasmid #1663). Cultivation of those ethanologenic hybrids was performed in GC vials for 72 hours. The Pdc activity after induction is indicated by the blue bars whereas the much lower activity of Pdc enzyme in the repressed state is given by the red bars. The induction factors for these plasmids #1578, #1701, #1658, #1697 and #1663 are 12, 10, 14, 8, and 7 times the PDC activity in the induced state vs. the repressed state. This figure depicts that specific nucleotide changes introduced into the ribosomal binding site and/or the promoter region of the nirA promoter in the respective variants PnirA*1, PnirA*2, PnirA*3 and PnirA*4 increased the expression level of the PDC in the induced state, but had relatively little impact on the tightness of the modified promoter in the repressed state.

Figure 82:
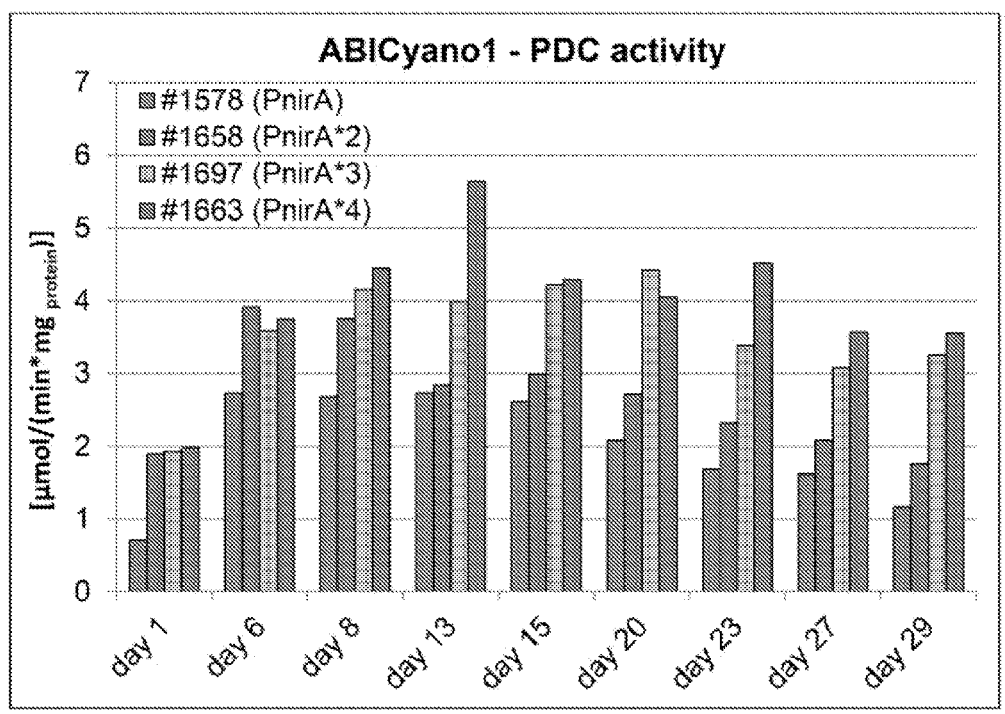
FIG. 82 depicts the activity of PDC during the course of a 30 day cultivation for ABICyano1 strains transformed with the plasmids #1578, #1658, #1697 and #1663.
Figure 83:
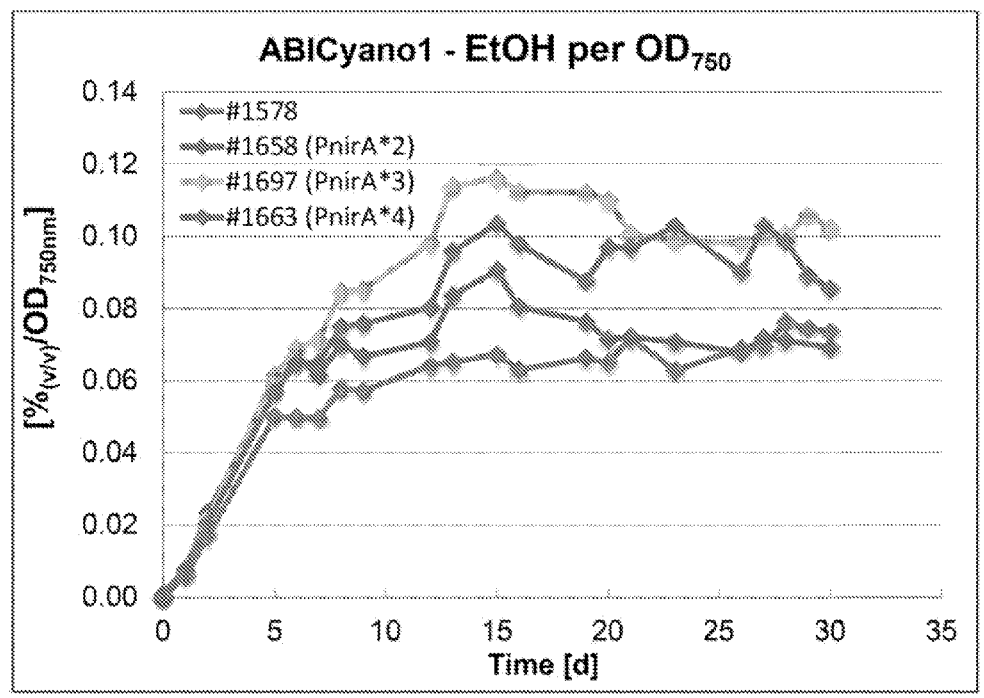
FIG. 83 depicts $OD_{750\ nm}$-normalized ethanol production (% EtOH per $OD_{750\ nm}$) during the course of a 29 day cultivation for ABICyano1 strains transformed with the plasmids #1578, #1658, #1697 and #1663.
Figure 84:
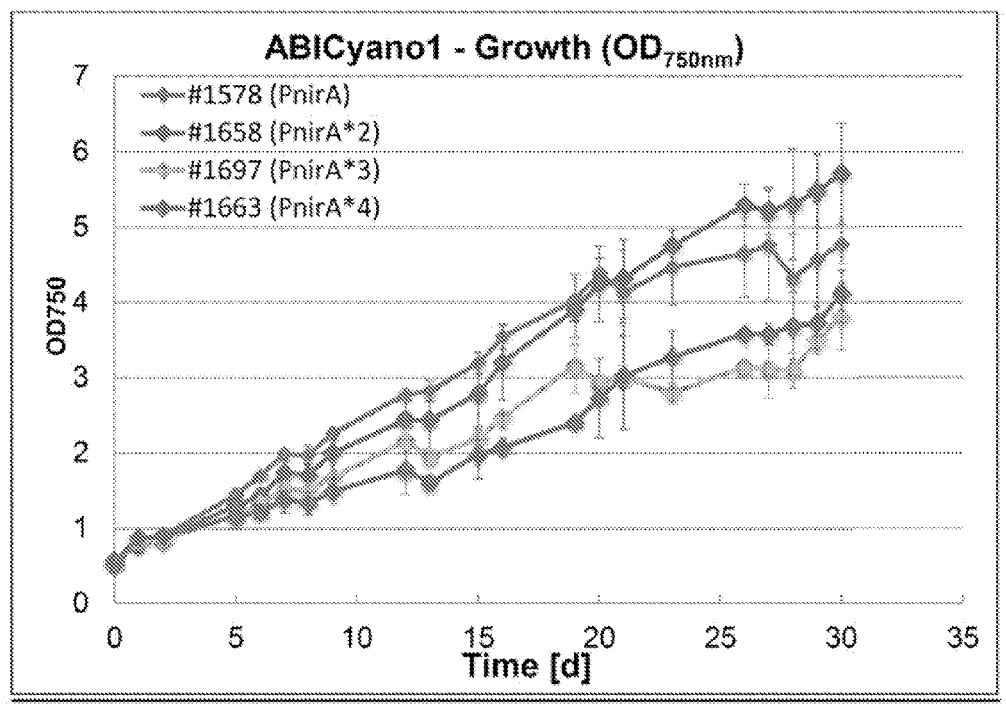
FIG. 84 depicts the $OD_{750\ nm}$ of a 30 day cultivation grown at 125 $\mu E*m^{-2}*s^{-1}$ in a 12 h/12 day/night cycle.
Figure 85:
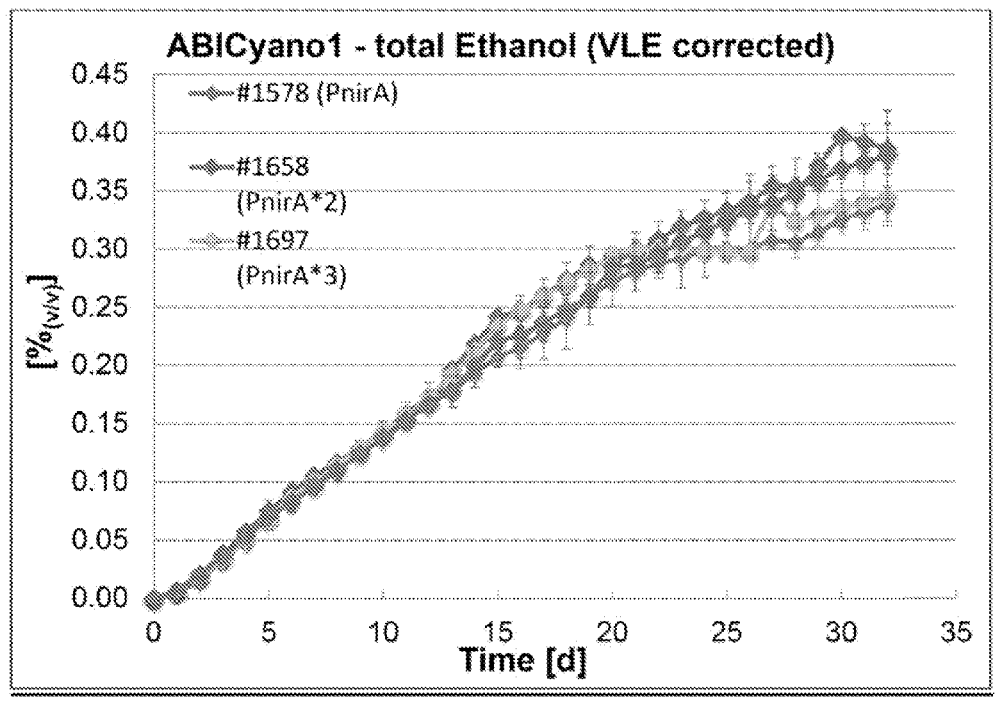
FIG. 85 depicts the ethanol production in % (v/v) of an about 30 day cultivation grown at 125 $\mu E*m^{-2}*s^{-1}$ in a 12 h/12 day/night cycle.

FIGS. 82 and 83 depict the activity of PDC and their respective OD$_{750nm}$-normalized ethanol production (% EtOH per OD$_{750nm}$) during the course of a 29 day cultivation grown at 125 µE*m$^{-2}$*s$^{-1}$ 12 h/12 day/night cycle for the above mentioned strains of FIG. 81 except for #1701 which was omitted. The PDC activity of #1697 (PnirA*3) and #1663 (PnirA*4) is higher and more stable over time than that of #1578 (PnirA) and #1658 (PnirA*2). Therefore the ratio of carbon distribution into ethanol and biomass (EtOH/OD ratio) is thereby higher and appears to be more stable over time for the transformants. FIGS. 84 and 85 depict the OD$_{750nm}$, and the ethanol production in % (v/v) of this about 30 day cultivation grown at 125 µE*m$^{-2}$*s$^{-1}$ in a 12 h/12 day/night cycle. The plasmid maps as well as the nucleic acid sequences of these plasmids have already been described above.

In an embodiment, higher C-branching (EtOH/OD ratio) for the strains transformed with plasmids #1697 (PnirA*3) and #1663 (PnirA*4) is related to the reduced growth compared to ABICyano1 strains transformed with plasmids #1578 (PnirA) and #1658 (PnirA*2), that show a similar ethanol production rate over about 29 days. Strains with a higher carbon branching ratio and thus reduced growth rate will enter the "light limited" growth phase later enabling a longer duration of high ethanol production. Delayed growth will extend the phase of "unlimited resources" for high ethanol yields (less cell aging effects, lower accumulation of inhibitory substance and lower respiration demand due to lower cell density).

Strains with Higher ADH Activity

High activity of synADH is accompanied with elevated PDC activity. Without being bound by theory, this is thought to occur because of reduced acetaldehyde exposure prevents PDC inactivation by reduced enzyme adduct formation with acetaldehyde (and/or other unknown inhibitory effects). Thus, in an embodiment, strains with increased expression of ADH from an adh cassette also have increased ethanol production even in the presence of high ethanol concentrations. In another embodiment, a method to reduce acetaldehyde exposure is disclosed that uses an increased amount of ADH that may work by stabilizing PDC activity over time.

Figure 86:
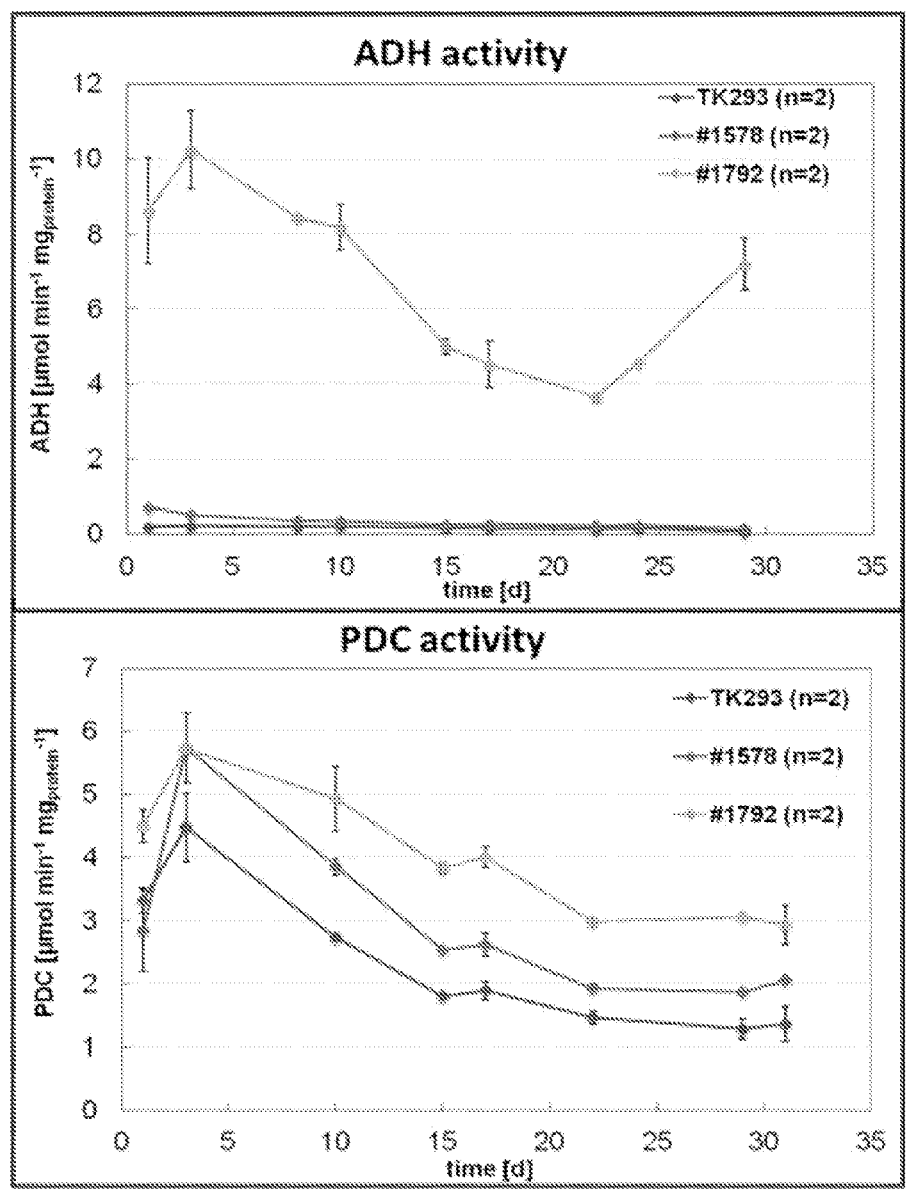
FIG. 86 depicts depicts ADH and PDC activity in TK293, 1578 and 1792.
Figure 87:
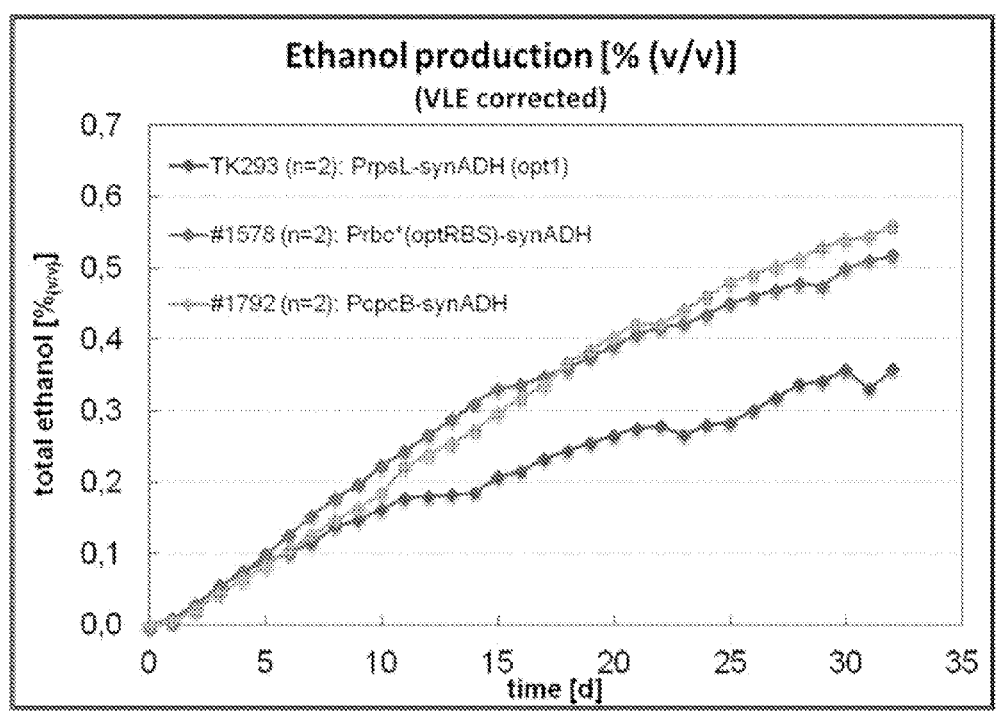
FIG. 87 depicts total ethanol production in TK293, 1578 and 1792.
Figure 88:
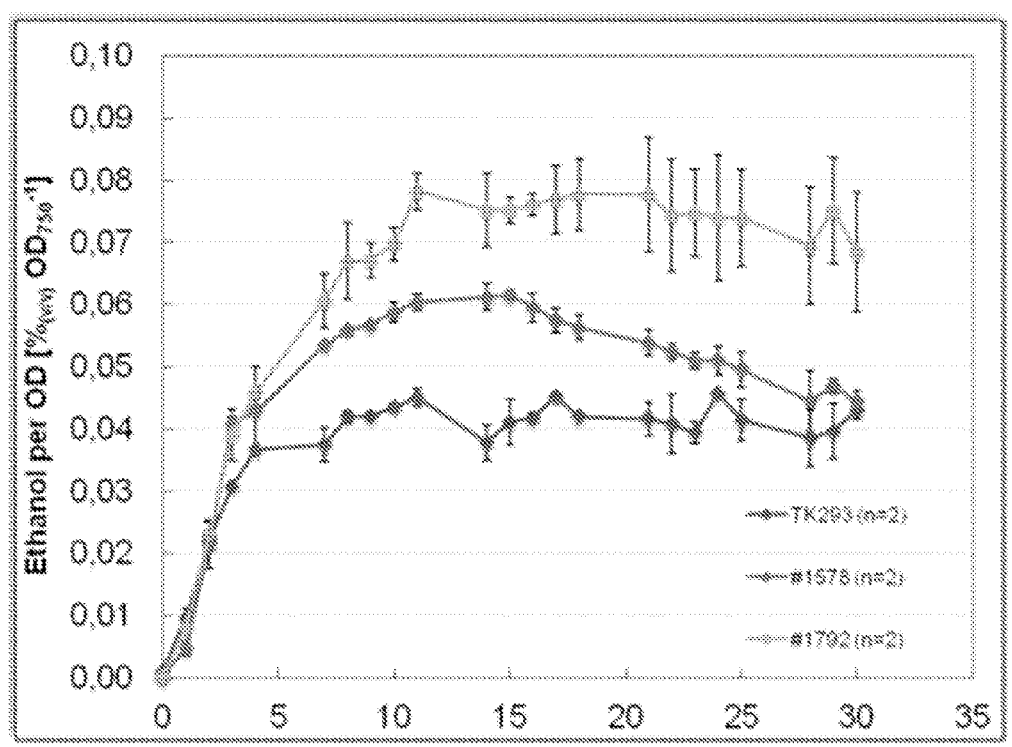
FIG. 88 depicts ethanol production per $OD_{750}$ in TK293, 1578 and 1792.
Figure 130:
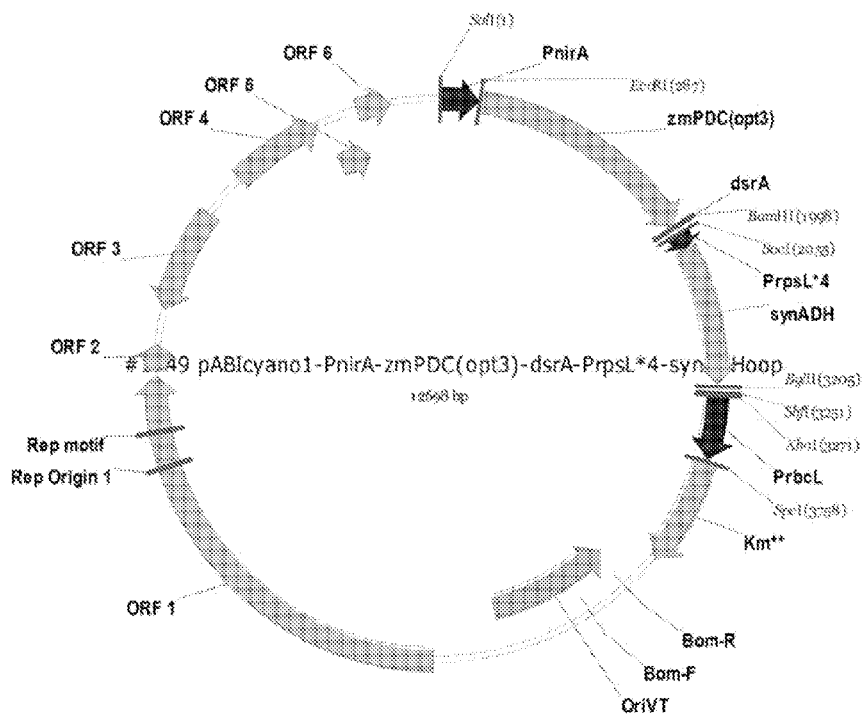

FIG. 86 depicts ADH and PDC activity in TK293, #1578 and #1792. FIG. 87 depicts total ethanol production in TK293, 1578 and 1792. FIG. 88 depicts ethanol production per OD$_{750}$ in TK293, #1578 and #1792. TK293 is pABICyano1-6.8::PnirA-zmPDC(opt1)-PrpsL-synADH(opt1)_ter; #1578 is pABICyano1-6.8::PnirA-zmPDC(opt3)dsrA-Prbc*(optRBS)-synADH_oop; #1749 is pABICyano1-6.8::PnirA-zmPDC(opt3)dsrA-PrpsL*4-synADH_oop (SEQ ID NO: 80) having a plasmid map depicted in FIG. 130 and #1792 is pABICyano1-6.8::PnirA-zmPDC(opt3)dsrA-PcpcB-synADH_TrbcS.

Figure 89:
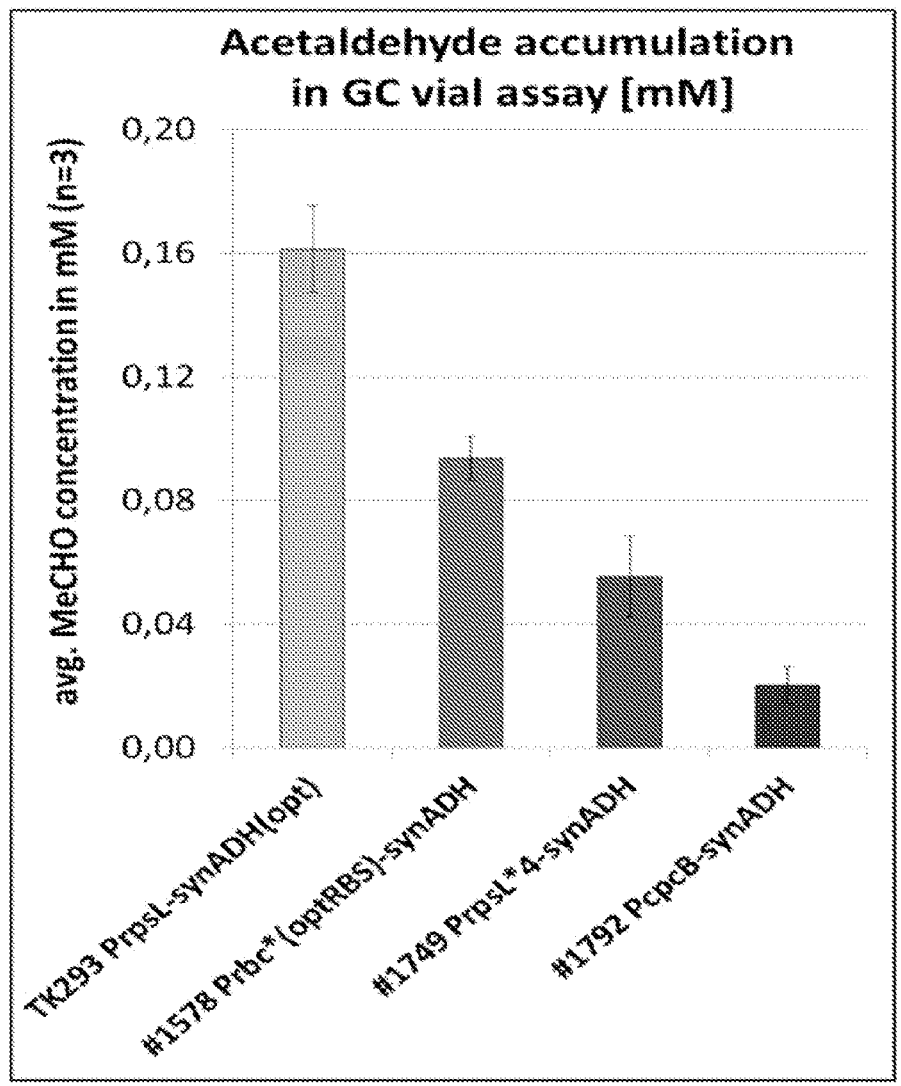
FIG. 89 depicts acetaldehyde accumulation of TK293, #1578, #1749, and #1792.
Figure 90:
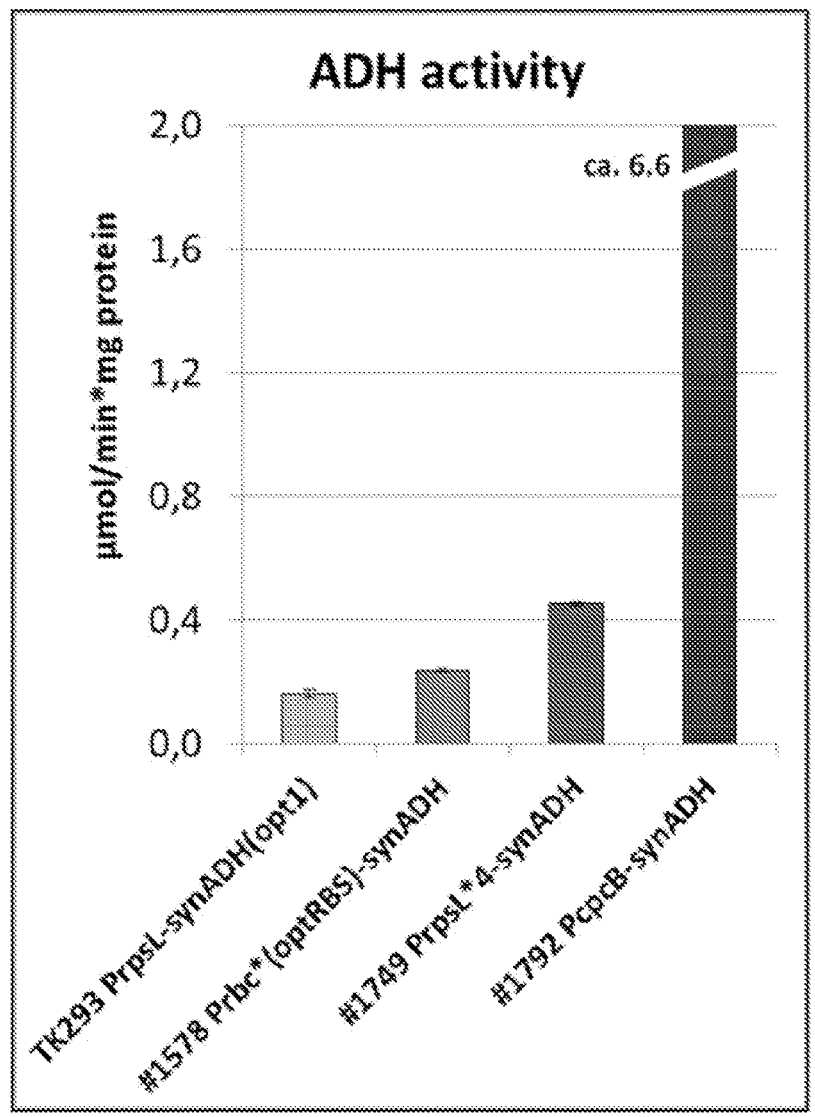
FIG. 90 depicts ADH activity in TK293, #1578, #1749, and #1792.
Figure 91:
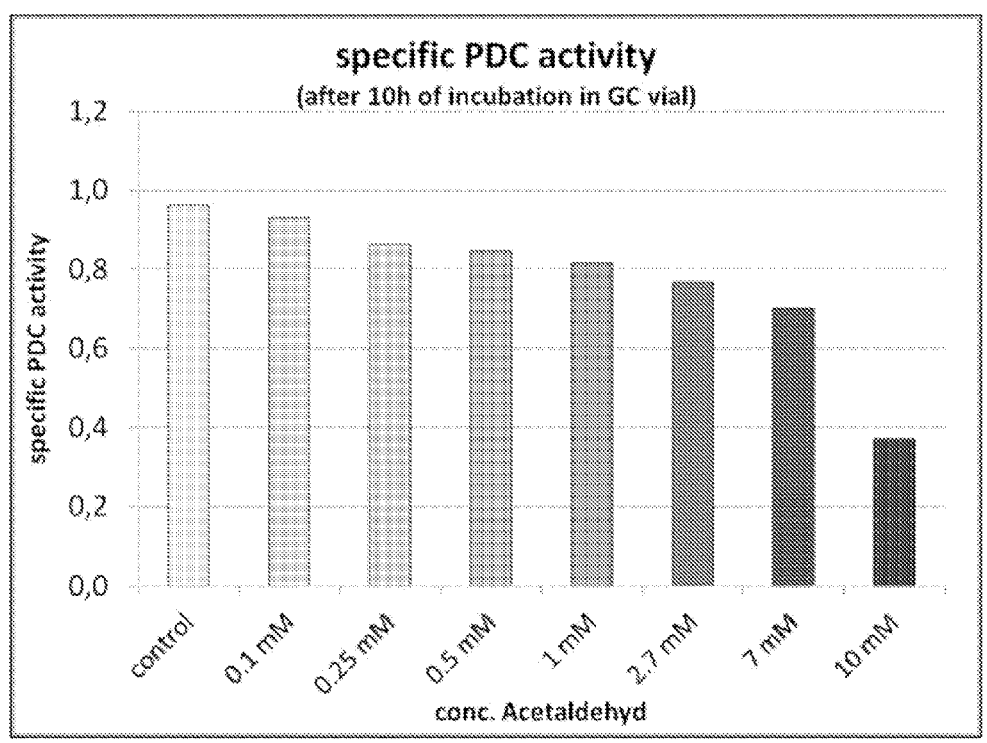
FIG. 91 depicts specific PDC activity in varying amounts of acetaldehyde added to the cells. Acetaldehyde is completely coverted to ethanol within 1-2 hours.

Plasmid #1792 results in improved synADH expression and shows better and more stable ethanol production under standard conditions. As depicted in FIGS. 89-91, increased ADH activity prevents PDC inactivation. FIG. 89 depicts acetaldehyde accumulation of TK293, #1578, #1749, and #1792. FIG. 90 depicts ADH activity in TK293, #1578, #1749, and #1792. Conversely, acetaldehyde exposure during cultivation reduces PDC activity. Thus, there is an inverse relationship between ADH activity and acetaldehyde accumulation for different synADH expressing strains in GC vial assay. FIG. 91 depicts specific PDC activity in varying amounts of acetaldehyde added to the cells. Acetaldehyde is completely converted into ethanol by the cells within 1-2 hours.

Figure 92:
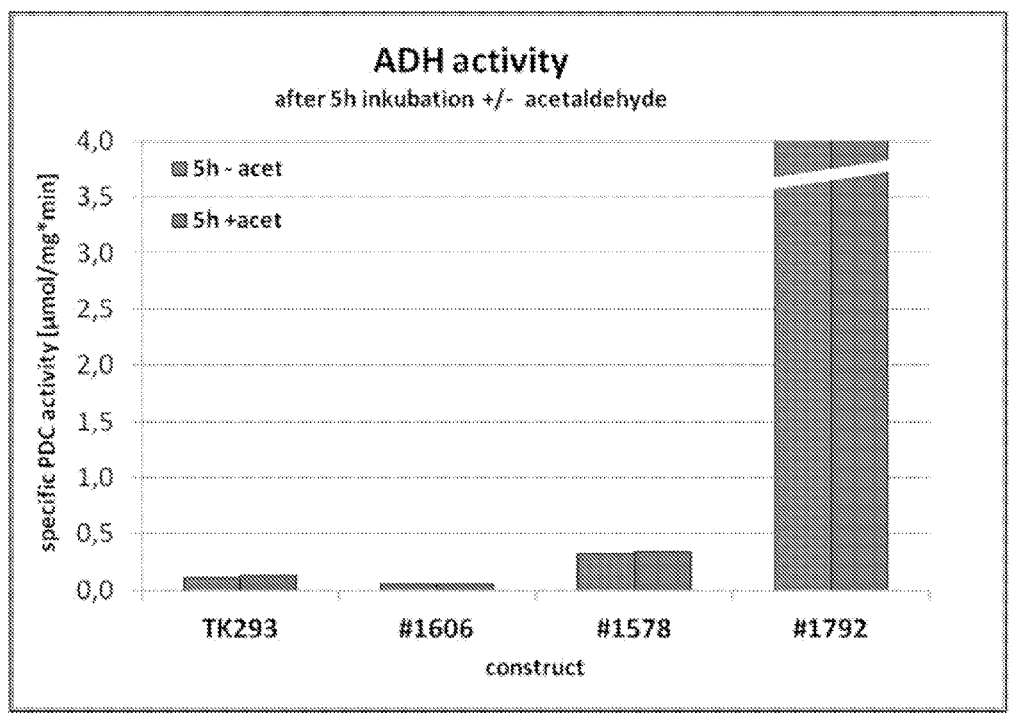
FIG. 92 depicts ADH activity with or without the addition of acetaldehye (3 mM for 5 hours) for strains TK293, #1578, #1749, and #1751 each having different ADH activity levels.
Figure 93:
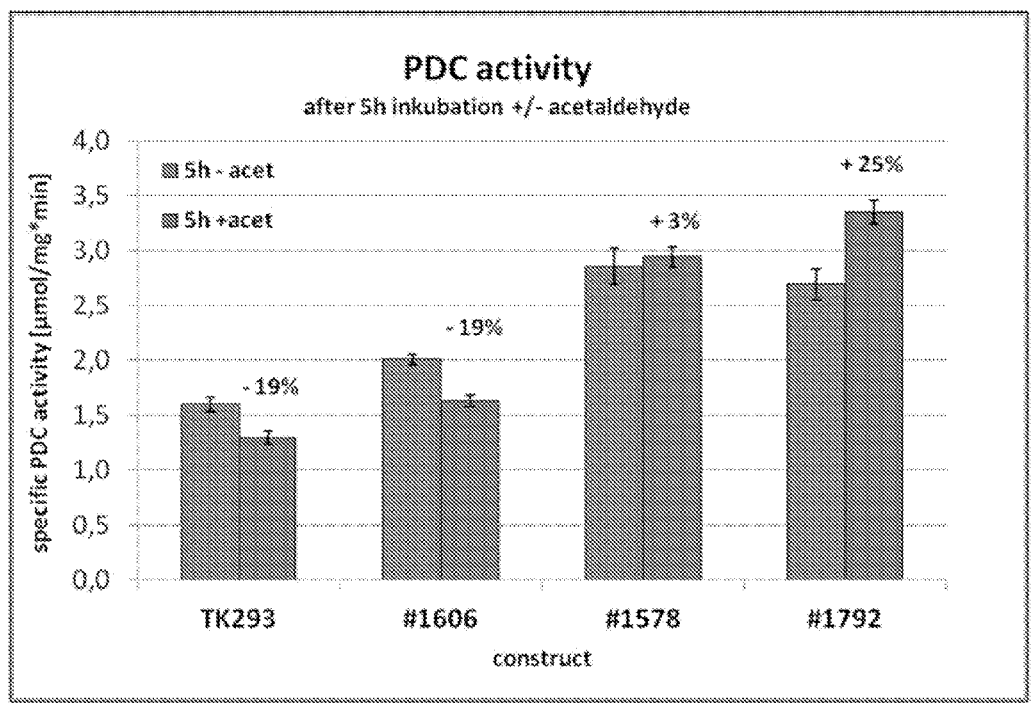
FIG. 93 depicts PDC activity with or without the addition of acetaldehye (3 mM for 5 hours) for strains TK293, #1578, #1749, and #1751 each having different ADH activity levels.

Higher ADH activity helps to prevent PDC inactivation. A decrease in PDC activity was detected for several strains with very low ADH activity (in spite of identical PDC cassettes). FIG. 92 depicts ADH activity and FIG. 93 depicts PDC activity with or without the addition of acetaldehye (3 mM and incubation for 5 hours) for strains TK293, #1578, #1749, and #1792 each having different ADH activity levels.

In an embodiment, ABICyano1 ethanologenic pdc/adh cassettes use different adh genes encoding ADH enzymes from differeint organisms, including, but not limited to, ADH111 (*Lyngbya*), ADH1520 (*Microcystis*), ADH553 (*Cyanothece*) and ADH242 (*Arthrospira*), ADH916 (*Synechococcus*) and ADH1102 (*Croococcidiopsis*). As an example. pdc/adh cassettes useful for extended production of ethanol in a ABICyano1 host cell include #1792 (pABICyano1-6.8::PnirA-zmPDC(opt3)_dsrA-PcpcB-synADH_TrbcS); #1791 (pABICyano1-6.8::PnirA-zmPDC(opt3)_dsrA-PcpcB-ADH111(opt)_TrbcS); #1793 (pABICyano1-6.8::PnirA-zmPDC(opt3)_dsrA-PcpcB-ADH916(opt)_TrbcS); #1794 (pABICyano1-6.8::PnirA-zmPDC(opt3)_dsrA-PcpcB-ADH1520(opt)_TrbcS); #1795 (pABICyano1-6.8::PnirA-zmPDC(opt3)_dsrA-PcpcB-ADH553(opt)_TrbcS) and #1749 (pABICyano1-6.8::PnirA-zmPDC(opt3)_dsrA-PrpsL*4-synADH_oop).

Figure 94:
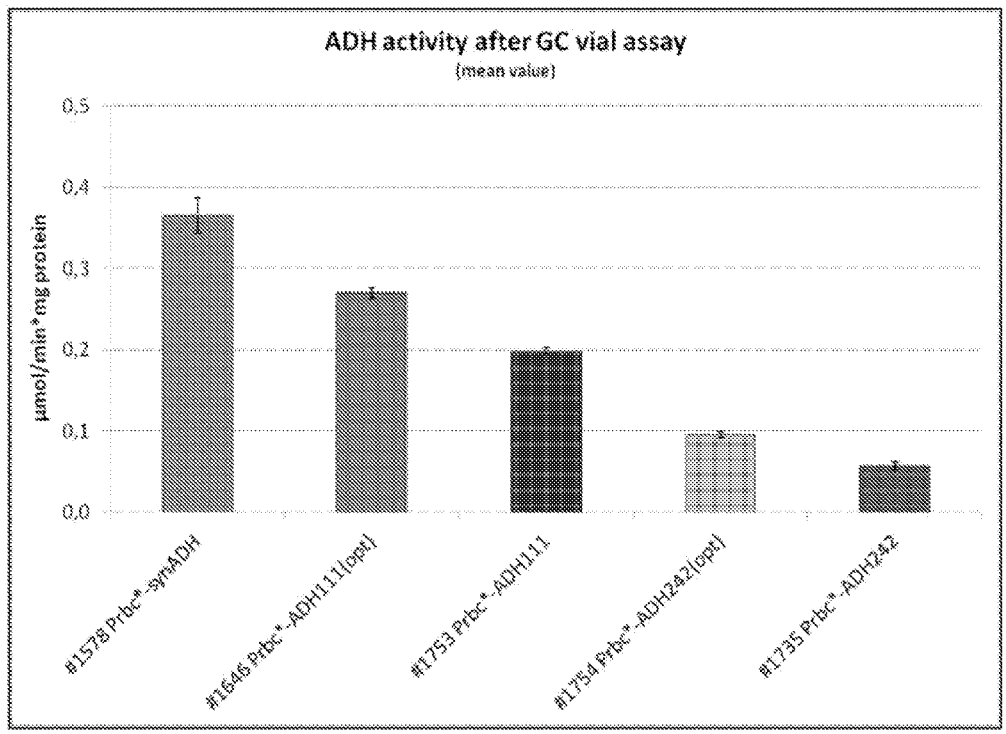
FIG. 94 depicts ADH activity of various expressed adh genes, some of which were codon improved for expression in ABICyano1.
Figure 128:
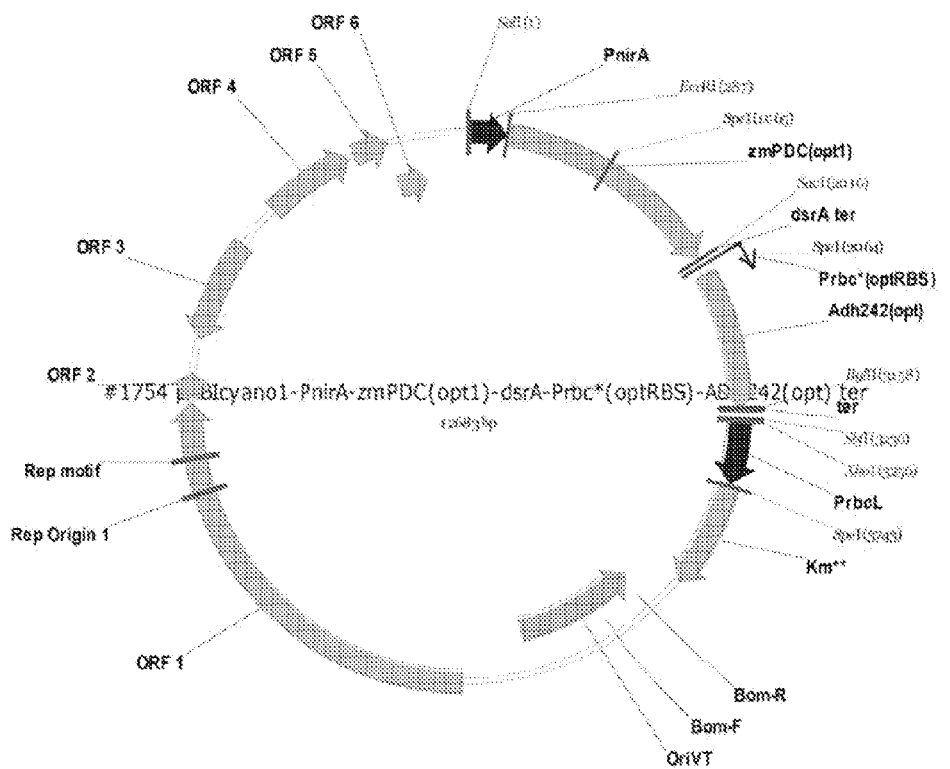
Figure 129:
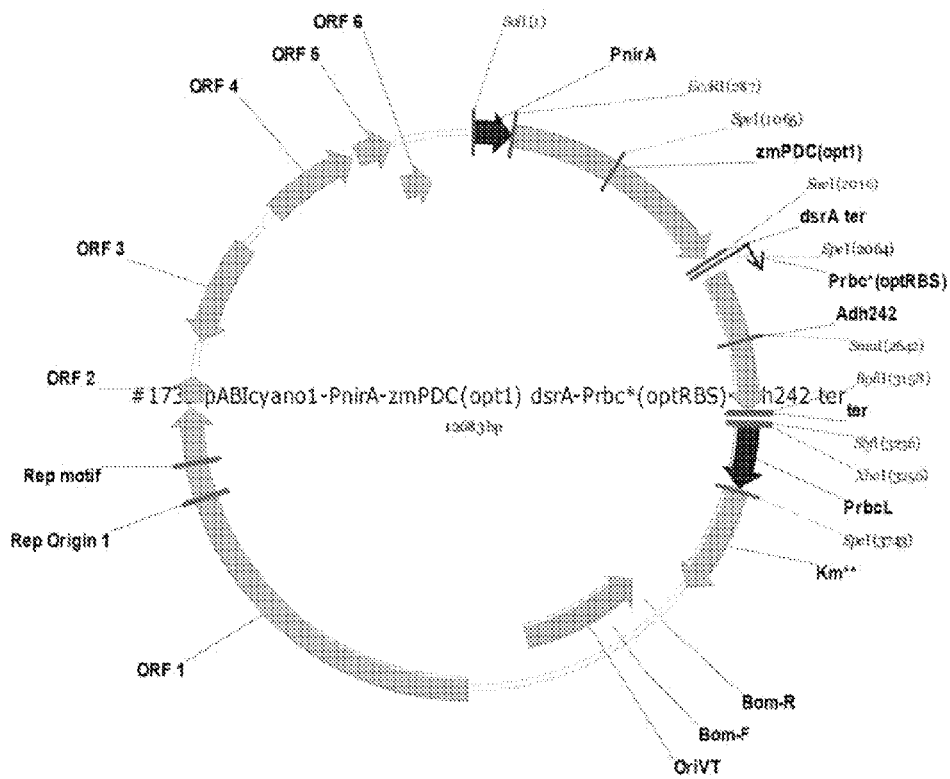

In another embodiment, the expression of heterologous adh genes from other cyanobacterial species that have been improved for codon usage patterns in ABICyano1 resulted in increased ADH activity. FIG. 94 depicts ADH activity of various expressed adh genes, some of which were codon improved for expression in ABICyano1. ADH242 is derived from *Arthrospira platensis* and ADH111 is derived from Lyngbya species. Constructs #1646 and #1754 (pABIcyano1-PnirA-zmPDC(opt1)-dsrA-Prbc*(optRBS)-ADH242(opt)_ter) (SEQ ID NO: 78) whose plasmid map with annotation is depicted in FIG. 128, had codon improved adh genes for ADH111 and ADH242, respectively. As depicted in FIG. 94, codon improvement for expression in ABICyano1 for the genes encoding for ADH111 and ADH242 resulted in an increase in ADH activity by about 30% to about 50%. FIG. 129 depicts a plasmid map with sequence annotation of plasmid #1735 (pABIcyano1-PnirA-zmPDC(opt1)_dsrA-Prbc*(optRBS)-Adh1694_ter) (SEQ ID NO: 79).

Figure 95:
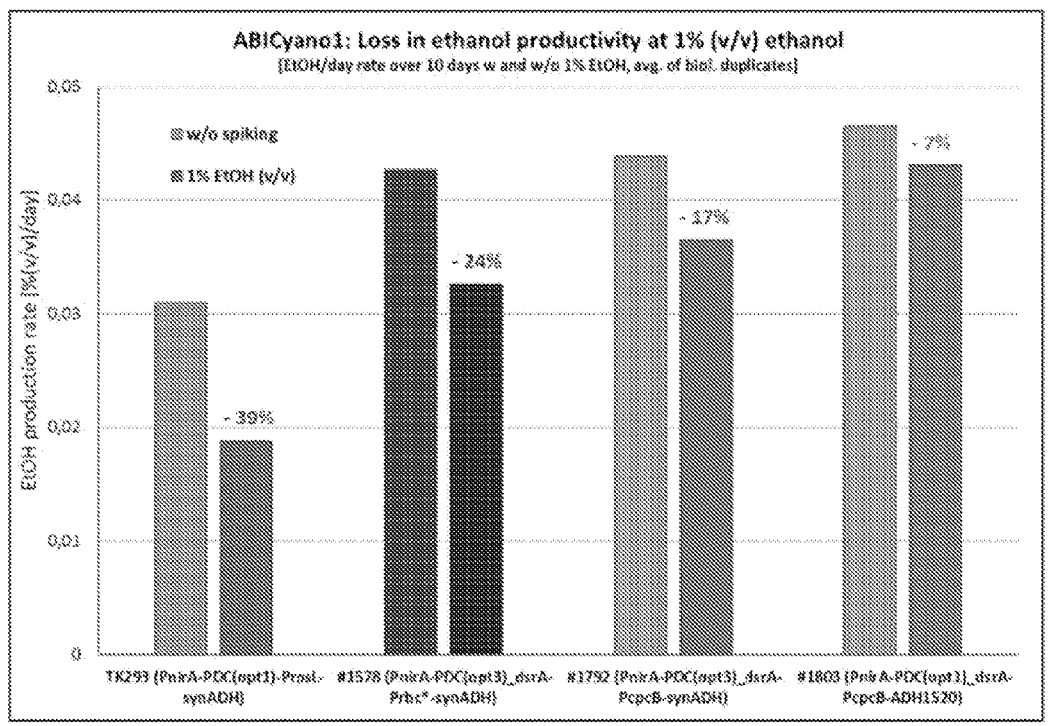
FIG. 95 depicts the effect of ethanol productivity of various ethanologenic ABICyano1 strains in growth media containing 1% vol/vol ethanol.

In another embodiment, increased ADH activity results in resistance to decreased ethanol production resulting from higher ethanol concentrations in the growth media. FIG. 95 depicts the effect of ethanol productivity of various ethanologenic ABICyano1 strains in growth media containing 1% vol/vol ethanol. As depicted in FIG. 95, the difference between the production rate of ethanol in growth media containing no added ethanol and growth media containing 1% added ethanol is less when the expression of ADH is higher. FIG. 95 depicts the daily ethanol production rate in percent vol/vol per day over 10 days as measured from ABICyano1 strains illuminated with 450 µE*m$^{-2}$*s$^{-1}$ (from two sides each) in 12 h/12 day/night cycles. As is depicted in FIG. 95, the stronger the ADH activity the less the impact of higher ethanol concentrations on ethanol production. As depicted in FIG. 95, ABICyano1 strain #1803 (plasmid map depicted in FIG. 137) (pABIcyano1-PnirA-zmPDC(opt1)\dsrA-PcpcB-Adh1520_ter) (SEQ ID NO: 87) that expresses ADH from *Microcystis aeruginosa* operably linked to the cpcB promoter exhibits less of a decrease in ethanol productivity (7% less) in a 1% ethanol growth solution when compared to the decrease in ethanol productivity of strain #1792 expressing ADH from Synechocystis PCC 6803 operably linked to the cpcB promoter (17% less).

Figure 96:
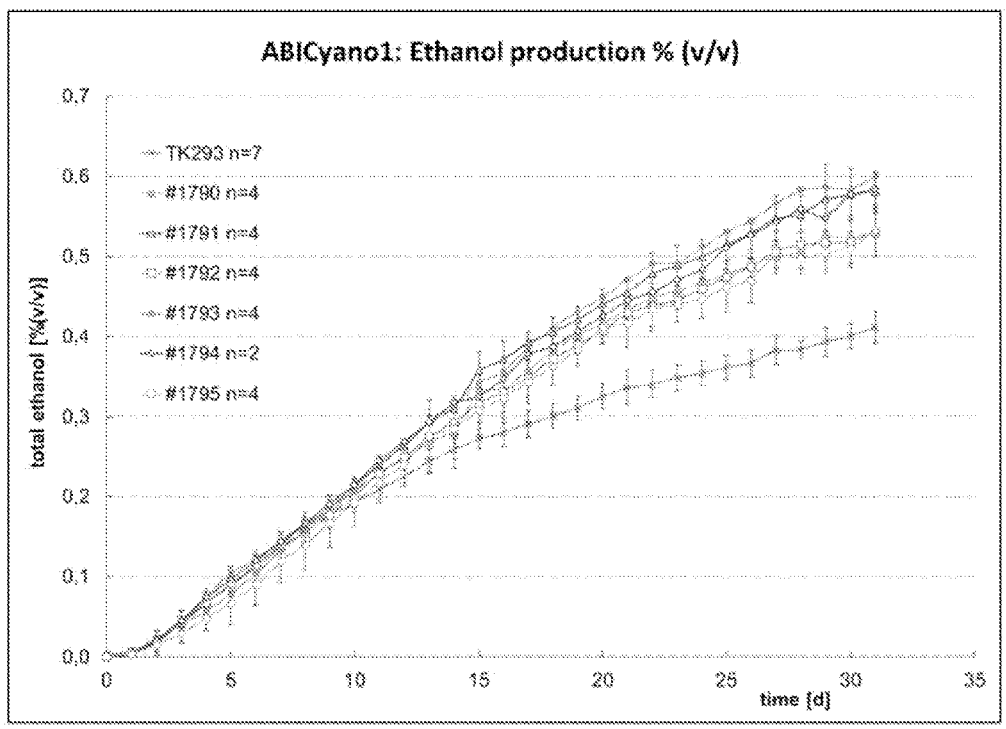
FIG. 96 depicts that the ethanol production of ABICyano1 strains 1790, 1791, 1792, 1793, 1794, and 1795 was greater than that of TK293 after about day 10 to about day 31 of growth.
Figure 131:
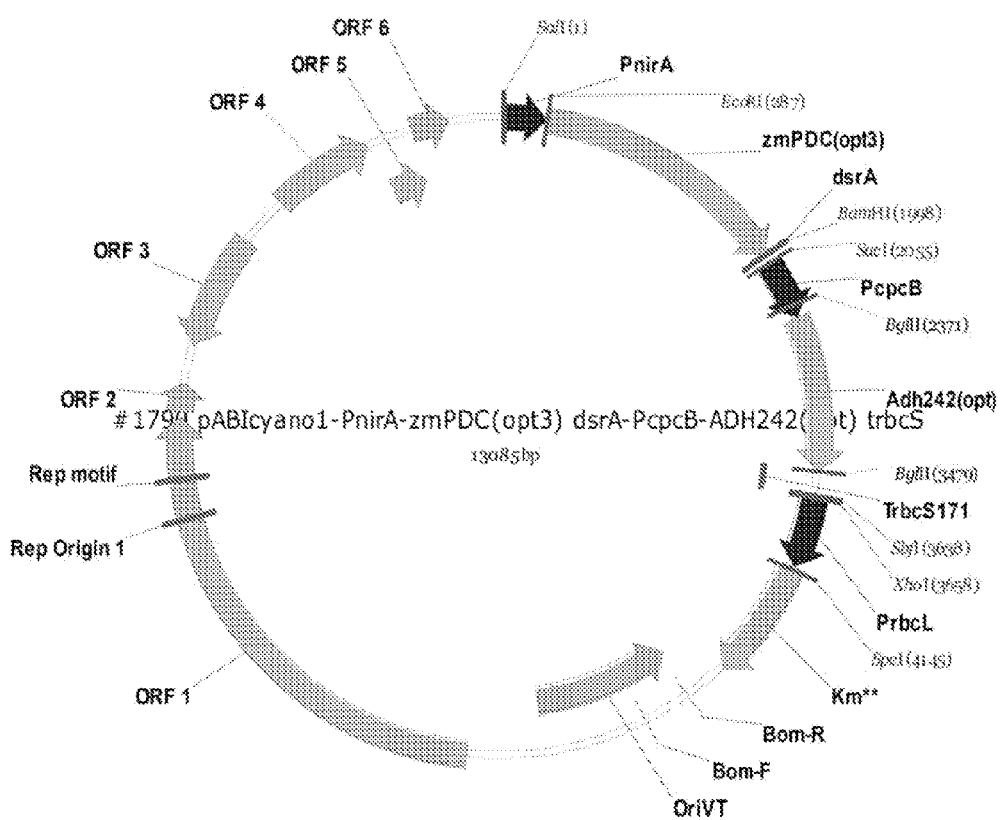

In an embodiment, ethanol production from ABICyano1 strains each containing a different adh gene operably linked to an endogenous ABICyano1 cpcB promoter and each strain containing a nirA promoter operably linked to pdc expression is depicted in FIG. 96. FIG. 96 also depicts the production of ethanol from strain TK293 (p171-6.8_PnirA-zmPDC(opt1)-PrpsL-synADH(opt1)_ter). Each strain depicted in FIG. 96 was cultivated in a vPBR system with exposure to light at 230 µE*m-2*s-1 (from one side) in a 12 h/12 day/night cycle. As depicted in FIG. 96, the ethanol production of ABICyano1 strains #1790, #1791, #1792, #1793, #1794, and #1795 was greater than that of TK293 after about day 10 to about day 31 of growth. ABICyano1 strain #1790 (SEQ ID NO: 81) has a plasmid map with annotations as depicted in FIG. 131. ABICyano1 strain #1791 (SEQ ID NO: 82) has a plasmid map with annotations as depicted in FIG. 132. ABICyano1 strain #1792 (SEQ ID NO: 83) has a plasmid map with annotations as depicted in FIG. 133. ABICyano1 strain #1793 (SEQ ID NO: 84) has a plasmid map with annotations as depicted in FIG. 134. ABICyano1 strain #1794 (SEQ ID NO: 85) has a plasmid map with annotations as depicted in FIG. 135. ABICyano1 strain #1795 (SEQ ID NO: 86) has a plasmid map with annotations as depicted in FIG. 136.

Dual Inducible Pdc Genes

Figure 97:
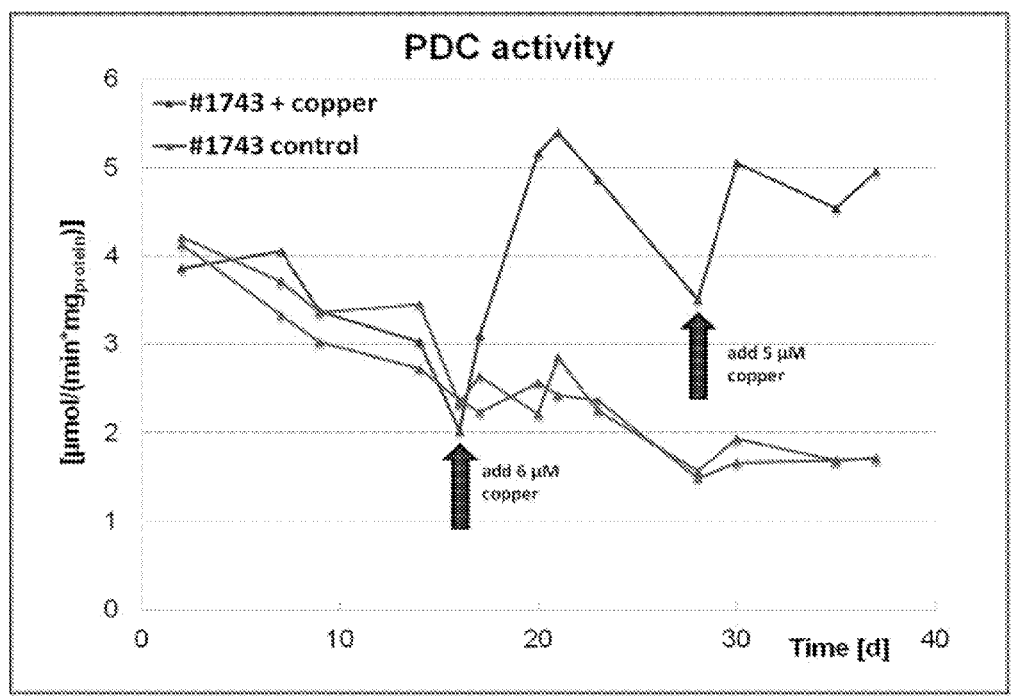
FIG. 97 depicts the PDC activity in dual PDC strain #1743 with and without induction of a second pdc gene by addition of 6 μM copper at about day 16 and the additional induction with 5 μM copper at about day 30.
Figure 98:
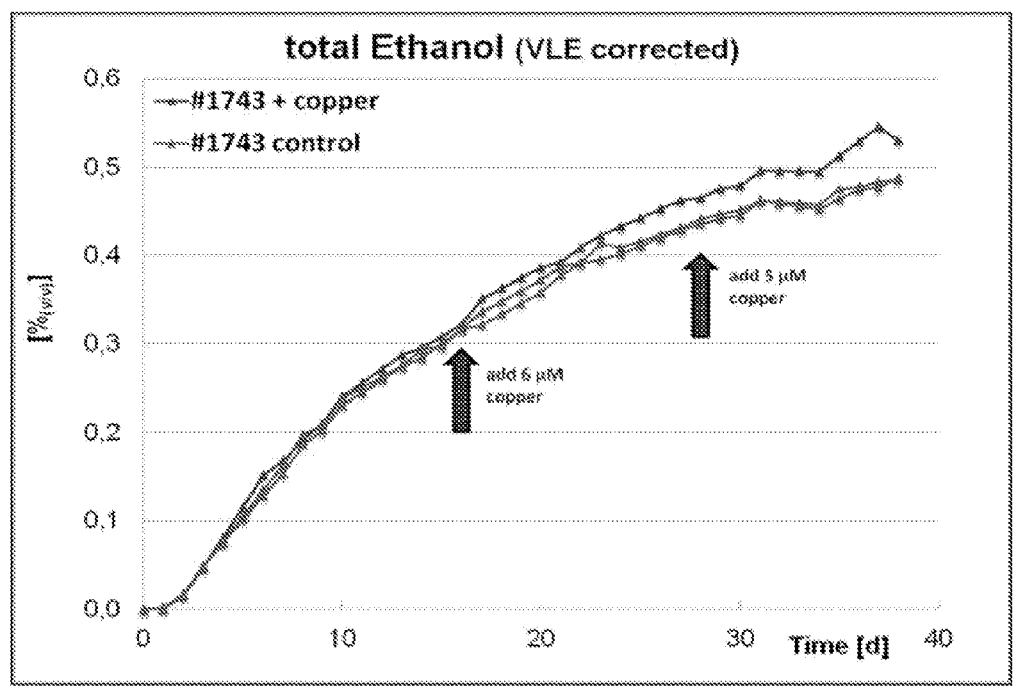
FIG. 98 depicts the total ethanol production of strain #1743 with and without the induction of copper.
Figure 99:
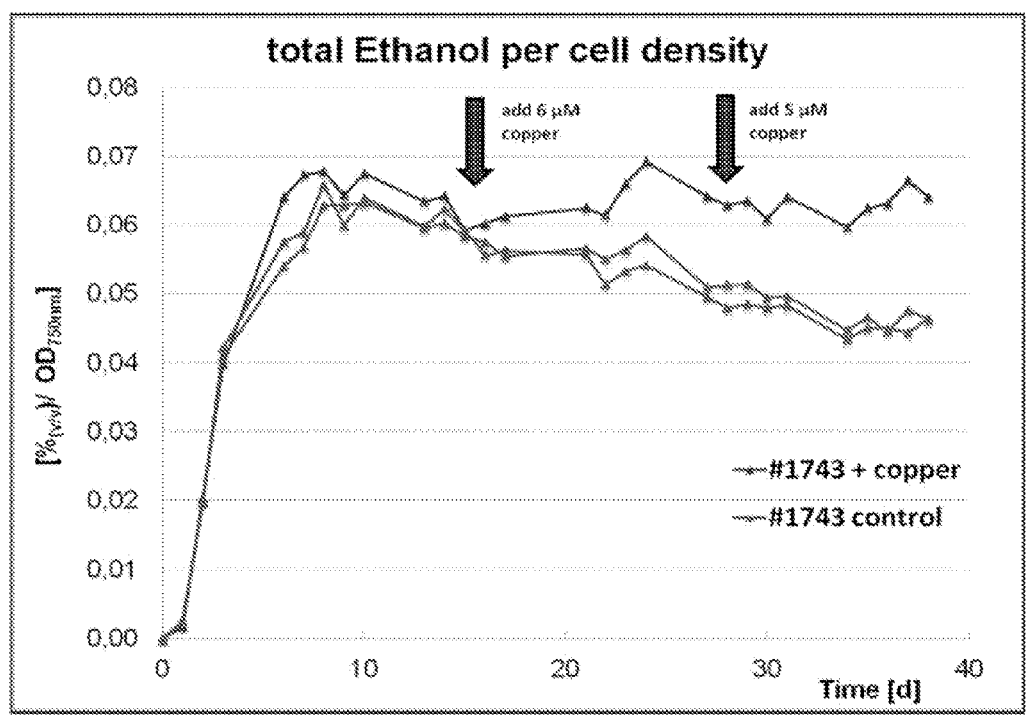
FIG. 99 depicts total ethanol per $OD_{750}$ of strain #1743.

In an embodiment, ABICyano1 host cells are transformed with ethanologenic vectors that contain more than one pdc gene. Induction of a second pdc gene increases PDC activity by about 2.5 times when compared to the induction of only a single pdc gene. Induction of a more than one pdc gene results in an increase in ethanol production and a decrease in cell growth. This ethanol production per $OD_{750}$ is higher for #1743 when both pdc genes are active. FIG. 97 depicts the PDC activity in strain #1743 with and without induction by 6 µM copper at about day 16 and the additional induction with 5 µM copper at about day 30. FIG. 98 depicts the total ethanol production of strain #1743 with and without the induction by copper. FIG. 99 depicts total ethanol per cell density measured at $OD_{750}$.

In an embodiment, dual pdc genes are introduced into an ABICyano1 host cell either on an integrative plasmid or on a replicative plasmid. Thus, the dual pdc genes, and other components of the ethanologenic cassette, can be integrated into the genome of ABICyano1 and/or exist on an extra-chromosomal plasmid within the ABICyano1 host cell. Strain #1743 is an ABICyano1 host cell containing a recombinant plasmid pABICyano1-6.8::PnirA-zmPDC171(opt3)dsrA-Prbc*(optRBS)-synADHoop*-Porf0221-zmPDC(opt1)dsrA. Strain #1743 has two independently inducible pdc copies where one pdc gene is inducible by nitrate and the other pdc gene is inducible by copper. Strain #1743 was analyzed for PDC activity in comparison to the corresponding single pdc strains #1578 (pdc under control of promoter PnirA) and #1771 (pdc under control of promoter Porf0221). The analyses revealed independently inducible expression of both pdc genes from one construct. Without nitrate and copper addition, the pdc genes of strain #1743 were as tightly repressed as the single pdc strains #1578 and #1771. Long-term cultivation experiments using a copper inducible pdc construct resulted in increased PDC expression when compared to other inducible pdc constructs such as nitrate inducible pdc constructs.

The second pdc gene of strain #1743 was induced at day 16 of cultivation in a photobioreactor (at an $OD_{750}$ of about 5.5) by addition of $Cu^{2+}$. Strain #1744 comprising plasmid #1744 (FIG. 161) (pABIcyano1-PnirA-zmPDC(opt3)-dsrA-Prbc*(optRBS)-synADH\oop-Porf3126-zmPDC(opt1)\dsrA) (SEQ ID NO: 111) having two pde genes under control of PnirA and Porf3126 ($Zn^{2+}$) was also induced at day 16 of cultivation in a photobioreactor (at an $OD_{750}$ of about 5.5). The PDC activity in each strain increased to a value of about 5-6 µmol/mg*min in comparison to a value of about 2.5 µmol/mg*min for the control replicates without copper addition. Ethanol production increased about 10-15% at day 37 of cultivation. Additionally, the ethanol to $OD_{750}$ ratio increased.

Figure 100:
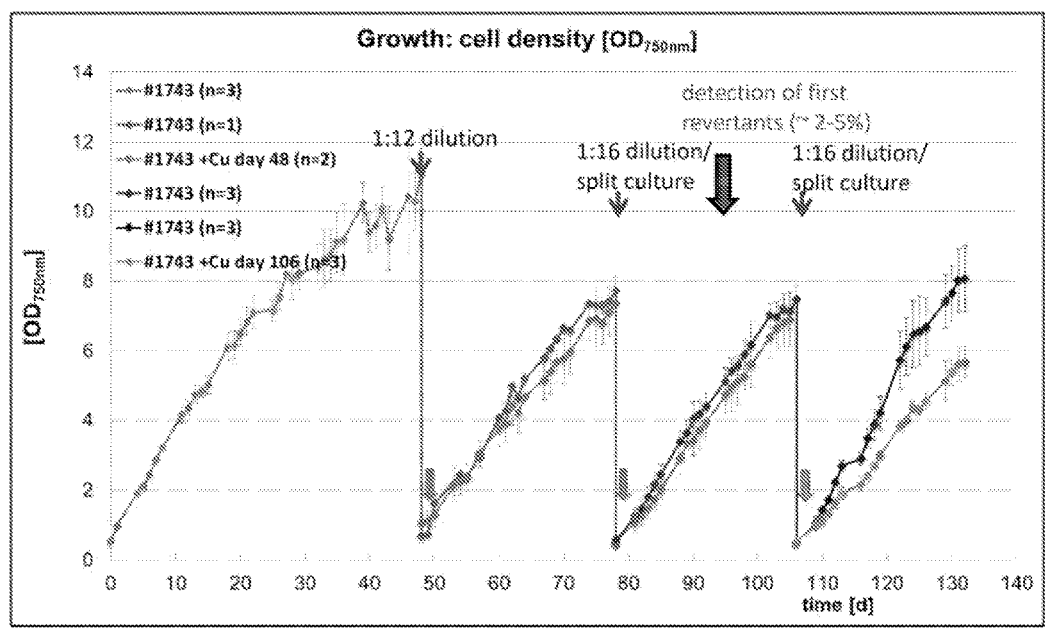
FIG. 100 depicts growth over 135 days and the addition of copper at days 48, 78 and 106 which caused a slight decrease in the rate of growth of ABICyano1 strain #1743 when compared to the control lacking copper in the growth media.

In an embodiment, the growth of strain #1743 containing two pdc genes, one pdc gene operably linked to a nirA promoter and a second pdc gene operably linked to the endogenous copper-inducible promoter Porf0221, is analyzed by measuring absoiption at $OD_{750}$ of the growth media after induction of the copper-inducible promoter Porf0221. As depicted in FIG. 100, cells were grown for 135 days and the addition of copper at day 48, 78 and at about day 106 caused a slight decrease in the rate of growth of ABICyano1 strain #1743 when compared to the control lacking copper in the growth media. As depicted in FIG. 100, a 1:12 dilution or a 1:16 dilution of the cultures is indicated by the thin arrows, the thick arrow depicts the first detection of revertants not having n first pdc gene expressing PDC enzyme.

Figure 101:
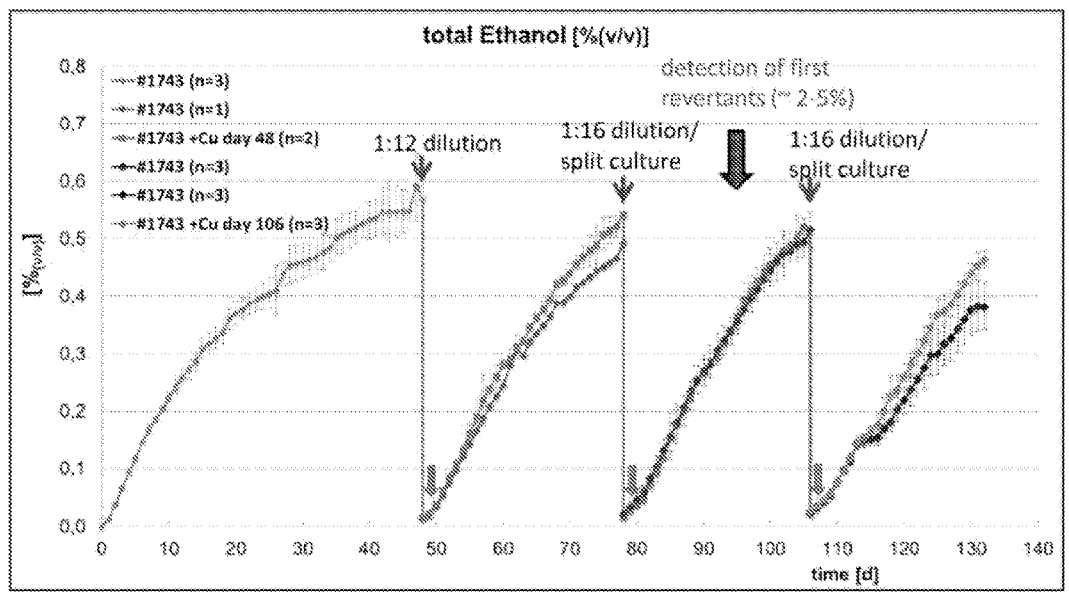
FIG. 101 depicts the production of ethanol from strain #1743 over a period of 135 days.

As depicted in FIG. 101, the production of ethanol from strain #1743 was measured in the same growth media as depicted in the $OD_{750}$ measurements of FIG. 100. In an embodiment, as depicted in FIG. 101, the overall ethanol production increased when copper was added to the growth media at days 48, 78 and 106. In another embodiment, PDC activity from strain #1743 was measured over about 135 days of growth. As depicted in FIG. 101, a 1:12 dilution or a 1:16 dilution of the cultures is indicated by the thin arrows, the thick arrow depicts the first detection of revertants not having n first pdc gene expressing PDC enzyme.

Figure 102:
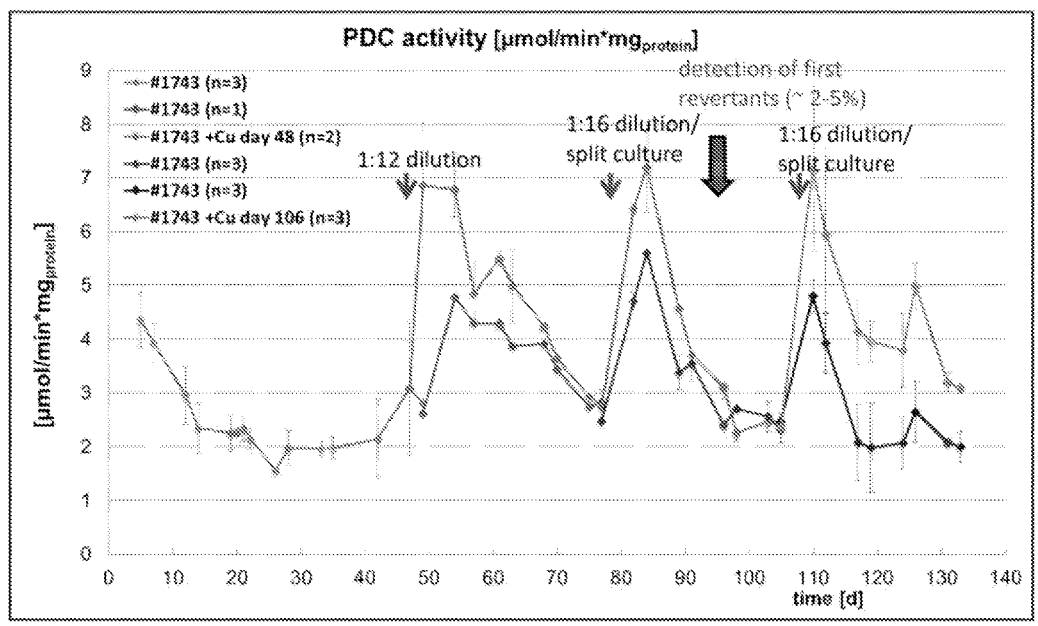
FIG. 102 depicts the PDC activity in ABICyano1 strain #1743 cells over the course of about 135 days.

FIG. 102 depicts the PDC activity in ABICyano1 strain #1743 cells from growth media over the course of about 135 days. The growth media was diluted at about days 48, 78 and 106 of growth. In another embodiment, the total ethanol produced per cell density was measured. As depicted in FIG. 102, a 1:12 dilution or a 1:16 dilution of the cultures is indicated by the thin arrows, the thick arrow depicts the first detection of revertants not having a first pdc gene expressing PDC enzyme.

Figure 103:
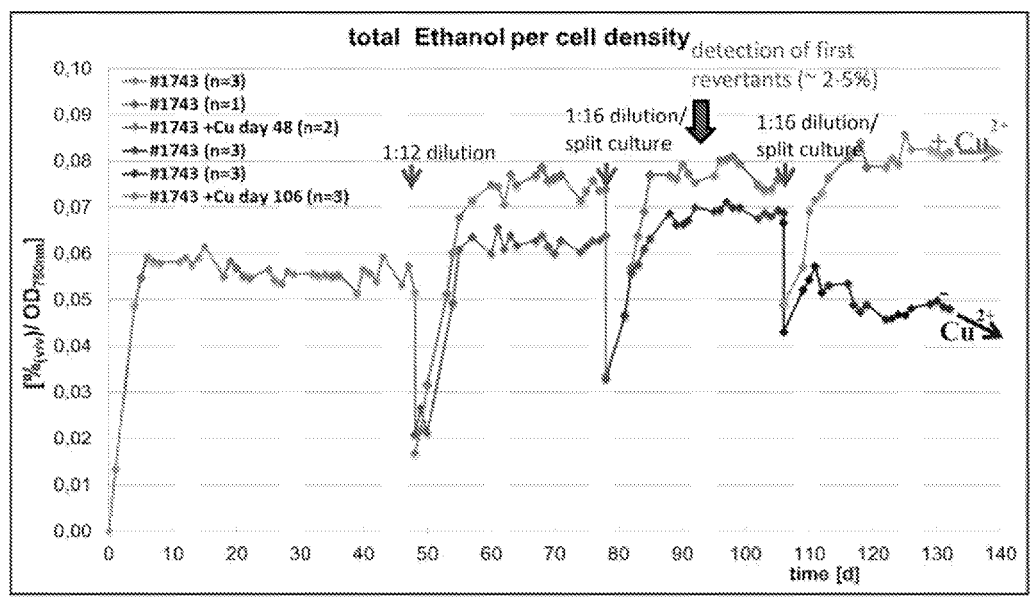
FIG. 103 depicts ethanol per $OD_{750}$ of strain #1743 that was grown for about 135 days and was diluted at about days 48, 78 and 106. As depicted in FIG. 103 the induction of the pdc gene by introduction of copper into the growth media results in an increase in the amount of ethanol produced per $OD_{750}$ of ABICyano1 strain #1743 when compared to the ABICyano1 strain #1743 grown in media lacking copper.

As depicted in FIG. 103, strain #1743 was grown for about 135 days and was diluted at about days 48, 78 and 106 of growth and amount of ethanol in percent volume per volume per $OD_{750}$ was measured. As depicted in FIG. 103 the induction of the pdc gene by introduction of copper into the growth media results in an increase in the amount of ethanol produced per $OD_{750}$ of ABICyano1 strain #1743 when compared to the ABICyano1 strain #1743 grown in media lacking copper. As depicted in FIG. 103, a 1:12 dilution or a 1:16 dilution of the cultures is indicated by the thin arrows, the thick arrow depicts the first detection of revertants not having n first pdc gene expressing PDC enzyme. As depicted in FIG. 103, the fat red arrow indicates the detection of first revertants (at about day 90). The top and bottom arrows on the far rights of FIG. 103 indicate the trend of carbon-partitioning (EtOH/OD) with and without copper addition respectively. With an increasing number of revertants, a decrease in carbon-partitioning towards ethanol is detectable. This decrease in carbon-partitioning towards ethanol can be compensated by activation of the second pdc copy ($+Cu^{2+}$), after which the EtOH/OD ratio remains about constant.

In another embodiment, and as depicted in FIG. 163, the PDC activity of strains #1578, #1743 and #1744 were tested with and without induction by nitrate and copper (#1578 and #1743) and with and without induction by nitrate and zinc (#1744). Strains #1743 (pABICyano1-6.8::PnirA-zmPDC(opt3)dsrA-Prbc*(optRBS)-synADH_oop-Porf0221-zmPDC(opt1)dsrA) and #1744 (pABICyano1-6.8::PnirA-zmPDC(opt3)dsrA-Prbc*(optRBS)-synADH_oop-Porf3126-zmPDC(opt1)dsrA) have two pdc copies on the pABIcyano1-6.8 kb plasmid under control of different promoters (inducible either by $NO_3^-/Cu^{2+}$ or $NO_3^-/Zn^{2+}$), both show functional and independent inducible expression of both pdc genes. As depicted in FIG. 163, PDC activity was measured about 48 h after induction. ABICyano1 strain #1578 (pABICyano1-6.8::PnirA-zmPDC(opt3)dsrA-Prbc*(optRBS)-synADH_oop) lacks a second pdc gene on the ethanologenic cassette. The second pdc gene can be turned on when the PDC activity from the first pdc gene is declining (due to decrease in promoter activity and/or PDC inactivation by genetic instability). Thus, PDC activity can be both maintained longer and at a higher rate in ABICyano1 strains comprising more than one pdc gene.

Homologous Recombination in ABICyano1

In an embodiment, homologous reconbination is used to introduce genes into ABICyano1 host cells. An ethanologenic gene cassette was successfully incorporated into the chromosome of ABICyano1 by using homologous recombination. FIG. 104 depicts the results of various homologous recombination (HR) events in ABICyano1. Different antibiotic resistance markers were introduced into the genome of ABICyano1 by using homologous recombination including GmR and KmR. The results of homologous reconinbination experiments in ABICyano1 host cells are depicted in FIG. 104. The single to double crossover ratio is about 10:1 using 2 kb homology arms. The use of 3 kb flanking regions for HR increases the frequency of double crossover events.

In an embodiment, transformation of *Cyanobacterium* sp. ABICyano1 with integrative plasmids which can integrate into the chromosomal DNA can be done in the same way as the transformation with extrachromosomal, self-replicating plasmids as disclosed herein. In an embodiment, the oriVT present in the integrative plasmids described in the following is only necessary for propagation of the plasmids in *E. coli* and for conjugative transfer into *Cyyanobacterium* ABICyano1. These integrative plasmids cannot replicate in *Cyanobacterium* sp., in particular in ABICyano1.

Figure 105:
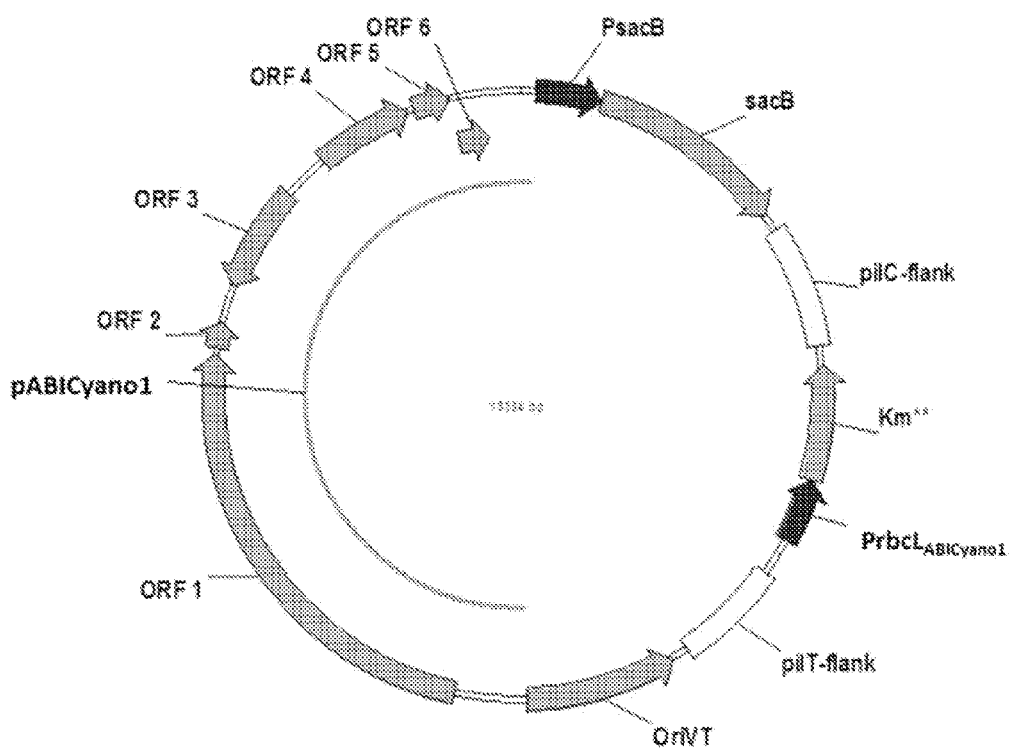
FIG. 105 depicts a plasmid map of TK471 (pABICyano1::pilT-PrbcLABICyano1_Km**pilC-sacB-oriVT)

In an embodiment, integration of target genes into the genome of ABICyano1 will be conducted with the help of plasmid TK471 (pABICyano1::pilT-PrbcLABICyano1_Km**pilC-sacB-oriVT) whose plasmid map is depicted in FIG. 105 (SEQ ID NO: 67), which was generated to integrate a kanamycin resistance gene in the pilT/pilC region, resulting in a pilT/pilC minus strain. The TK180 based plasmid contains a pilT flanking region of ABICyano1 upstream as well as a pilC flanking region of ABICyano1 downstream of the kanamycin resistance gene to generate a double crossover event in ABICyano1. Moreover, sacB from *Bacillus subtilis* is encoded on TK471. Expression of sacB in gram negative bacteria grown on media supplemented with sucrose is toxic for the bacteria. Hence, only the bacteria which lose the sacB gene are able to grow on sucrose plates. ABICyano1 TK471 strains grown on sucrose/kanamycin plates are therefore forced to induce homologous recombination to flip the kanamycin resistance gene into the genome and to lose the plasmid TK471 due to the presence of the sacB gene. In order to integrate the EtOH cassette into the genome, plasmid TK471 will be modified dallying the EtOH cassette adjacent to the Km gene (also within the pilT and pilC flanking region).

Figure 106:
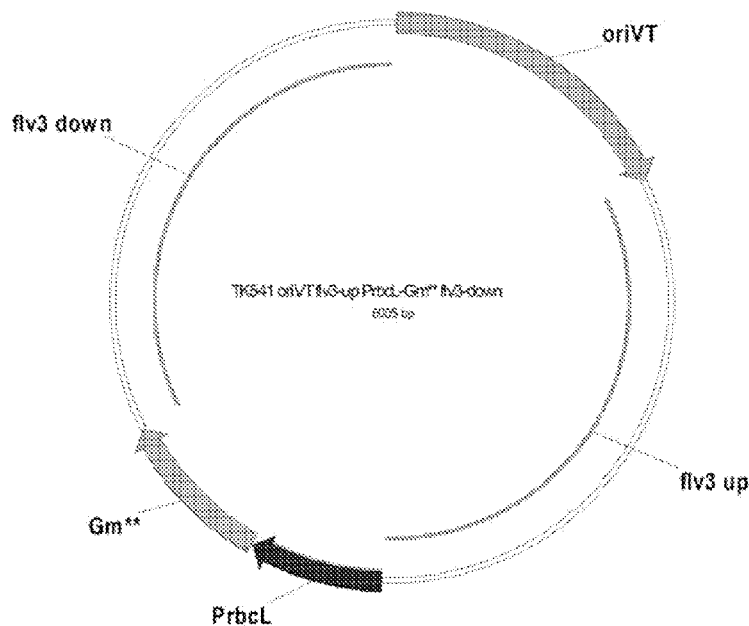
FIG. 106 depicts the plasmid map of TK541 (oriVT_flv3-up_PrbcL-Gm**_flv3-down).

Integration of target genes into the genome of ABICyano1 was conducted with the help of plasmid TK541 (oriVT_flv3-up_PrbcL-Gm**_flv3-down) whose plasmid map is depicted in FIG. 106 (SEQ ID NO: 68), which was generated to integrate a gentamycin resistance gene into orf2849 (flv3). The oriVT based plasmid TK541 contains a flanking region of orf2849 of ABICyano1 upstream as well as a flanking region of orf2849 of ABICyano1 downstream of the gentamycin resistance gene to generate a double crossover event in ABICyano1 in order to insert the sequence between both flanking regions of orf2849 into the genome of ABICyano1 via homologous recombination.

Figure 107:
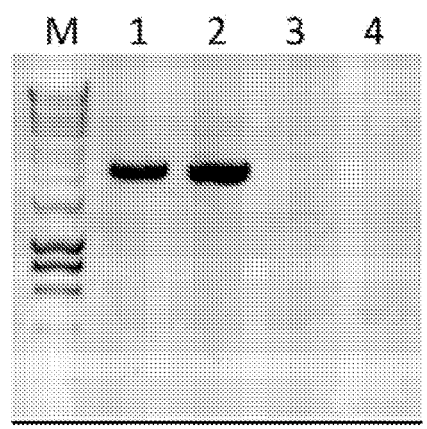
FIG. 107 depicts a DNA agarose gel of a PCR reaction using two PCR primers including one primer specific for the gentamycin resistance gene and the other primer binding within the genome of ABICyano1.

FIG. 107 depicts a DNA agarose gel of a PCR reaction using two PCR primers including one primer specific for the gentamycin resistance gene and the other primer binding within the genome of ABICyano1. This PCR was performed in order to identify the integration of the gentamycin resistance gene into the genome of *Cyanobacterium* sp. ABICyano1 via transformation with the above mentioned plasmid TK541. The line marked with "M" denotes the marker. Lanes 1 and 2 show PCR signals using two different clones of *Cyanobacterium* sp. ABICyano1 transformed with the plasmid TK541, whereas lanes 3 and 4 are PCR reactions using and analyzing the untransformed wild-type of Cyanobacterium sp. ABICyano1 and *E. coli* containing plasmid TK541, respectively (negative control). It can clearly be seen that only lanes 1 and 2 give a PCR signal thereby evidencing the integration of the gentamycin resistance gene into the genome. The integration shown on the DNA agarose gel of FIG. 107 relates to a single cross-over integration where only one flanking region of orf2849 (flv3) is involved, but not the other one. This results in an integration of the antibiotic resistance conferring gentamycin cassette of TK541 into the genome of ABICyano1 without excision of parts of the chromosome of ABICyano1. The recombination frequency for a double crossover involving both flanking regions of orf2849 is lower than for a single cross over recombination so that a double crossover event with plasmid TK541 could also have been identified if more transformants were screened.

Figure 108:
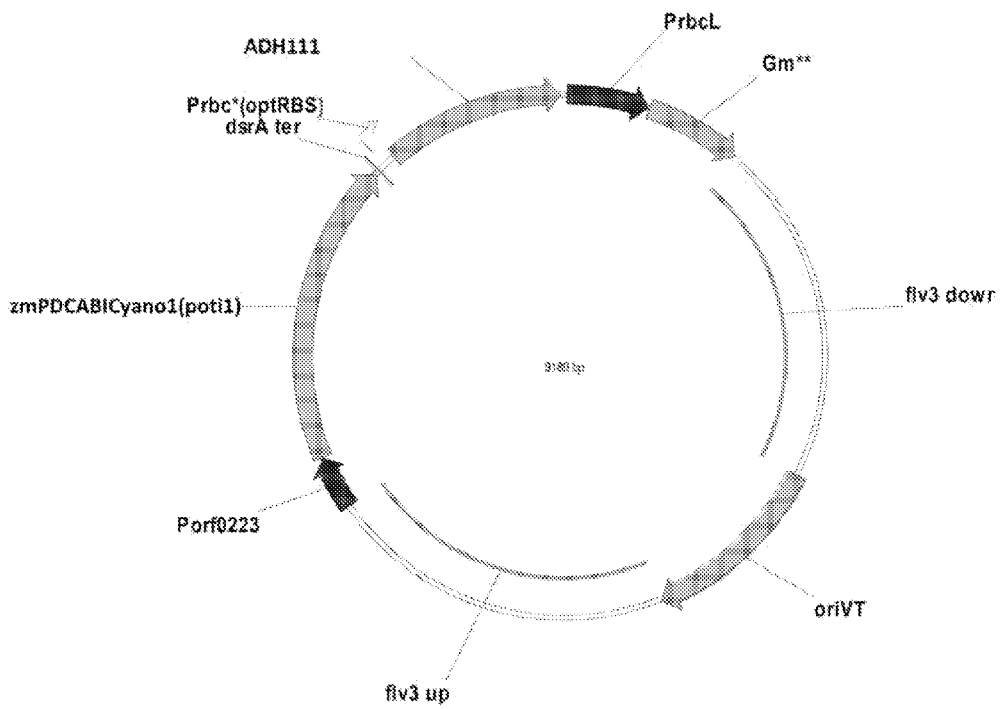
FIG. 108 depicts a plasmid map of TK554 (4oriVTflv3-upPorf0223ABICyano1-zmPDCABICyano1(opt)dsrA-Prbc*(optRBS)-ADH of FIG. 66B (ABICyano1) Prbd_Gm**flv3-down).

An additional plasmid, TK554 (4oriVTflv3-upPorf0223ABICyano1-zmPDCABICyano1(opt)dsrA-Prbc*(optRBS)-ADH111(ABICyano1)Prbd_Gm**flv3-down) whose plasmid map is depicted in FIG. 108 (SEQ ID NO: 69), was constructed which is a derivative of TK541 and which includes an ethanologenic cassette in addition to the antibiotic resistance conferring gentamycin cassette. This plasmid will be used in order to introduce recombinant genes involved in ethanol production into the genome of ABICyano1 via homologous recombination in the same way as for TK541.

Figure 109:
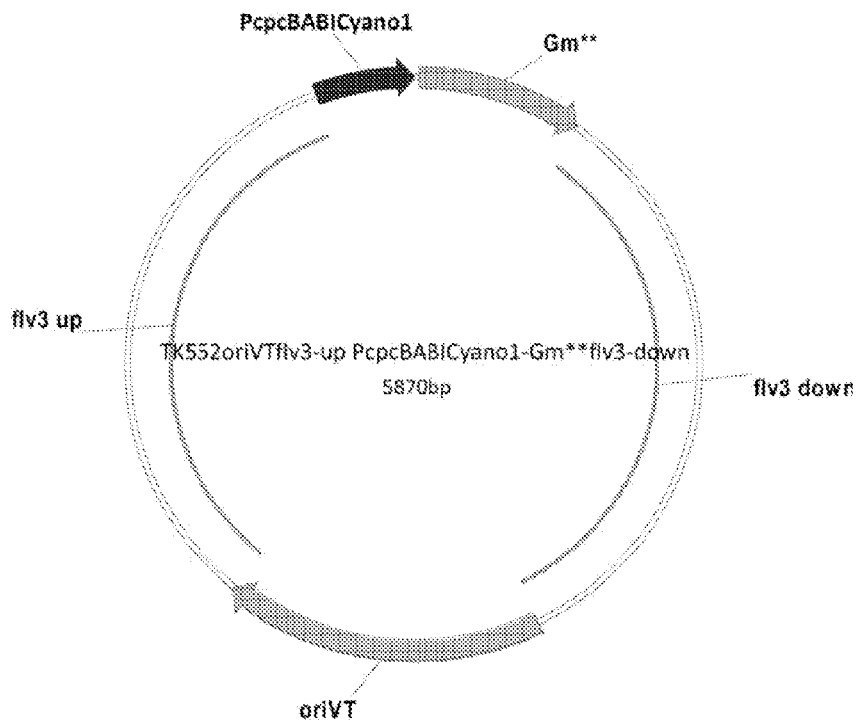
FIG. 109 depicts a plasmid map of TK552 (oriVT_flv3-up_PcpcBABICyano1-Gm**_flv3-down).
Figure 110:
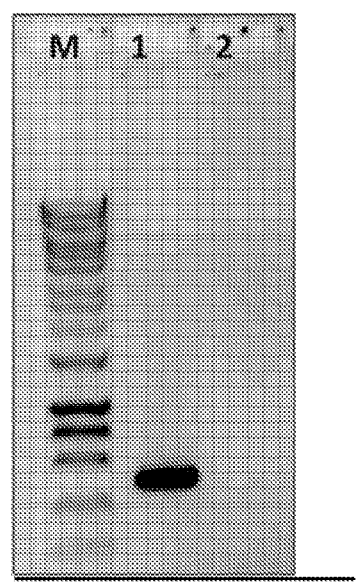
FIG. 110 depicts an agarose gel with lane "1" and "2" being a PCR reaction performed with primers specific for the gene flv3.

Another integrative plasmid TK552 (oriVT_flv3-up_PcpcBABICyano1-Gm**_flv3-down) whose plasmid map is depicted in FIG. 109 (SEQ ID NO: 70) was constructed which in comparison to the plasmids TK541 and TK554 contains a different promoter, PcpcB, for the gentamycin gene. This promoter is also an endogenous promoter of ABICyano1. For this plasmid integration into the genome of ABICyano1 was shown via a double cross-over homologous recombination event, thereby resulting in the excision of a genomic region of the chromosome of ABICyano1 which is located between both flanking regions flv3up and flv3down (see FIG. 110). FIG. 110 shows in lane "1" and "2" a PCR reaction performed with primers specific for the gene flv3. Lane 2 corresponding to the ABICyano1 strain transformed with TK552 shows that the gene flv3 was deleted, whereas a clear signal of flv3 can be detected in lane "1" corresponding to the wild type ABICyano1. The lane denoted with "M" is a marker. Therefore the integrative plasmids can also be used in order to delete genomic regions of ABICyano1 by integrating a recombinant gene into its genome. This strategy can for example be used in order to provide targeted knock outs or gene disruptions of endogenous genes of *Cyanobacterium* sp., in particular ABICyano1 and at the time integrating at least one recombinant gene into the genome.

Figure 111:
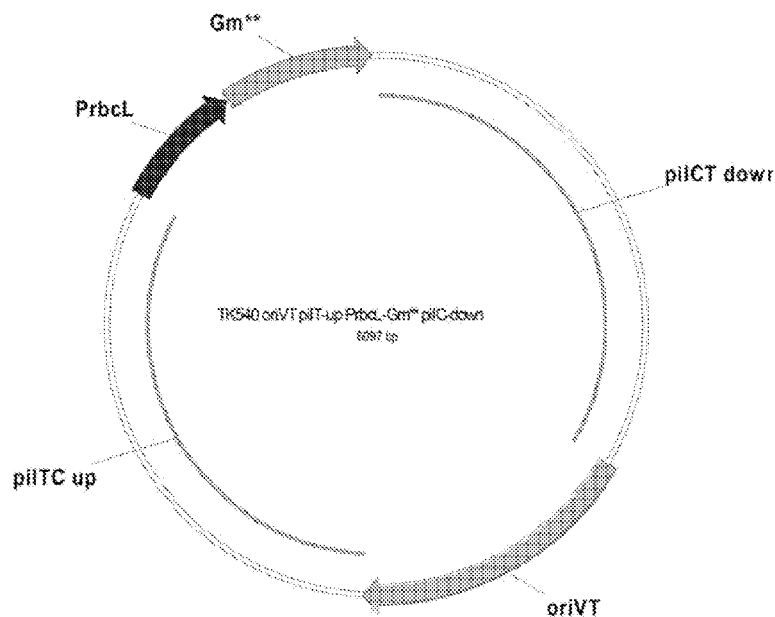
FIG. 111 depicts a plasmid map of TK540 (oriVT_pilT-up_PrbcL-Gm**_pilC-down).
Figure 112:
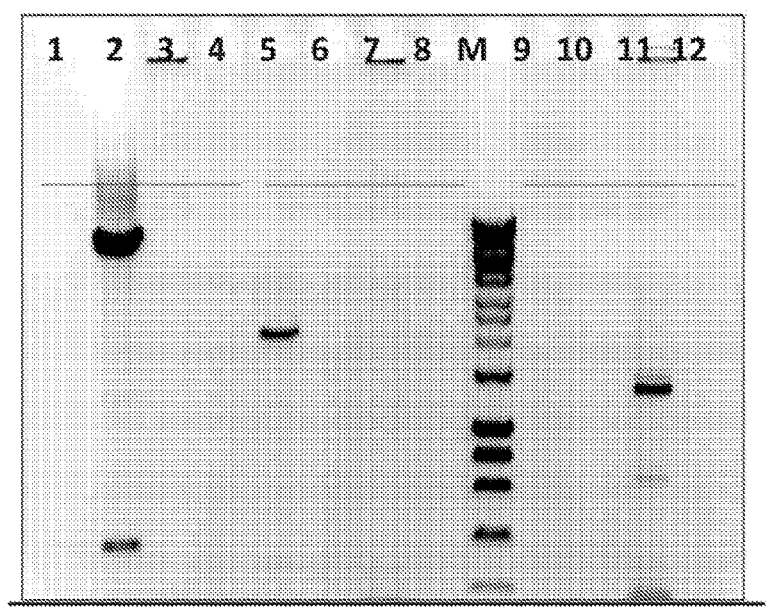
FIG. 112 is an image of a 0.8% DNA agarose gel that depicts single and double cross over integration of the TK540 plasmid into the genome of ABICyano1 as detected by PCR with primer specific for regions outside the pilT/pilC region.

In another embodiment, plasmid TK540 (oriVT_pilT-up_PrbcL-Gm**_pilC-down) whose plasmid map is depicted in FIG. 111 (SEQ ID NO: 71) was constructed, which can integrate into a different locus pilT/pilC in comparison to the plasmids TK541, TK552, and TK554. As depicted in FIG. 112, a 0.8% DNA agarose gel depicts analysis for single and double cross over integration of this plasmid into the genome of Lanes 1 to 4 show the PCR analysis for a potential double cross-over event in the pilT/pilC region with primers specific for regions outside the pilT/pilC region. These primers give a positive signal for ABICyano wild-type and would give a small PCR product if a double cross-over integration took place. Lane 1 shows the lack of a double cross-over PCR signal for pilT/pilC for ABICyano1 transformed with TK540. Lane 2 depicts the expected wild-type ABICyano1 band and lane 3 shows the lack of a PCR signal for *E. coli* containing plasmid TK540 as a negative control. Lane 4 shows the PCR reaction using $H_2O$ instead of DNA (technical negative control). Lanes 5 to 8 depict the detection of single crossover integration into the pilT upstream region with lane 5 showing the PCR signal for ABICyano1 transformed with TK540. Lane 6 again depicts the wild type ABICyano1 and lane 7 shows the lack of a PCR signal for *E. coli* containing plasmid TK540. Lane 8 shows a PCR reaction with $H_2O$. Lanes 9 to 12 depict the detection of a single crossover integration into the downstream region of pilC with lane 9 presenting no PCR signal for ABICyano1 transformed with TK540, and lane 10 showing the wild type ABICyano1. Lane 11 shows background PCR signals for *E. coli* containing plasmid TK540 and lane 12 is a negative control PCR reaction with water. M denotes the marker.

In an embodiment, plasmids for chromosomal integration in the ABICyano1 genome at the pilTC locus were constructed. The plasmids used optimized $P_{nirA}$ promoters $P_{nirA*2}$, $P_{nirA*3}$, $P_{nirA*4}$, and $P_{orf0316}$ driven PDC(opt1) along with a $P_{cpcB}$-synADH cassette. The plasmids used KmR, GmR and CmR marker genes. As depicted in FIG. 113, strains used for transformation included #1817 (SEQ ID NO: 107) (pflv3::PnirA-zmPDC(opt1)_dsrA-Prbc*(optRBS)-synADH\oop-PrbcL-Gm**) whose plasmid map is depicted in FIGS. 157, and #1818 (SEQ ID NO: 108) (flv3::$P_{orf0316}$-zmPDC(opt1) dsrA-$P_{rbc*}$(optRBS)-synADH oop-$P_{rbcL}$-Gm**) whose plasmid map is depicted in FIG. 158, both of which already would have one PDC/ADH cassette in the chromosome in the flv3 locus.

FIG. 113 depicts the results of various HR experiments including particular gene knockouts in the genome of ABICyano1 as well as various gene introductions into the genome of ABICyano1 host cells by HR. Knockouts created by HR include ΔnarB, ΔargH, and ΔleuB. Gene introductions include $P_{nirA}$-pdc/adh, $P_{orf0316}$-pdc/adh, and promoters used variously include PrbcL and/or PcpcB for expression of the Gm resistance. In an example, nirA and adhE genes are knocked out by HR in ABICyano1.

Figure 114:
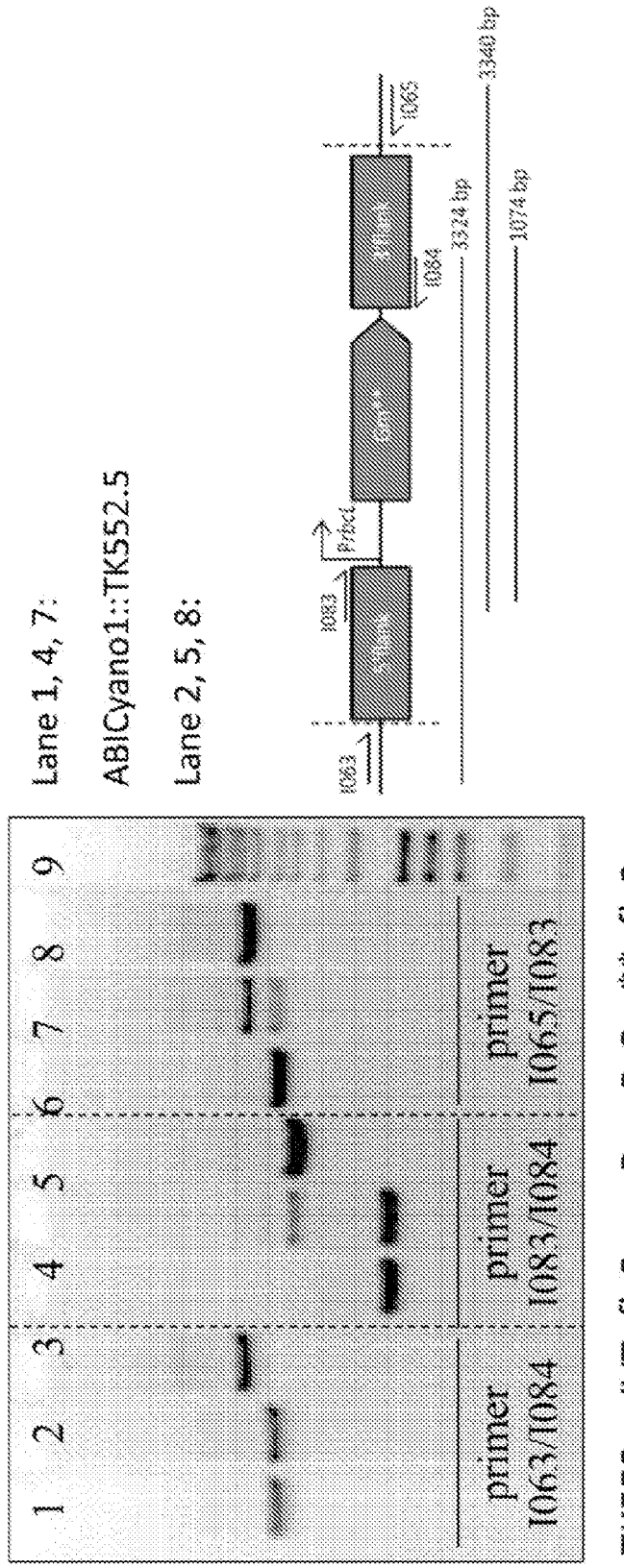
FIG. 114 depicts PCR-based segregation analysis shows that an ABICyano1 organism transformed with construct TK552 (pOriVT_flv3-up_PcpcB-Gm_flv3-down) successfully integrated an antibiotic resistance marker gene (Gm) into to the flv3 gene in the chromosome of ABICyano1 and confirms complete segregation of TK552.5 for all chromosome copies.

In an embodiment, chromosomal integrative plasmids were used to integrate a marker gene into the chromosome of ABICyano1 at the flv3 gene. As depicted in FIG. 114, PCR-based segregation analysis shows that an ABICyano1 organism transformed with construct TK552 (pOriVT_flv3-up_PcpcB-Gm_flv3-down) successfully integrated an antibiotic resistance marker gene (Gm) into to the flv3 gene in the chromosome of ABICyano1. FIG. 114 also depicts various stages of segregating the cell populations having the marker integrated into only some of the population of transformed ABICyano1 cells and populations having the marker integrated into all of the population of transformed ABICyano1 cells. As depicted in FIG. 114, ABICyano1 clone TK552.5 is completely segregated whereas ABICyano1 clone TK552.8 is only partially segregated (about 80%).

In another embodiment, chromosomal integrative plasmids were used to integrate a GmRmarker gene into the chromosome of ABICyano1 at the ycf37 gene. As depicted in FIG. 115, PCR-based segregation analysis shows that an ABICyano1 organism transformed with construct TK616 (pOriVT_ycf37-up_FRT-PcpcB-Gm-ter-FRT_ycf37-down) successfully integrated an antibiotic resistance marker gene (Gm) into to the ycf37 gene in the chromosome of ABICyano1. FIG. 115 also depicts various stages of segregating the cell populations having the marker integrated into only some of the population of transformed ABICyano1 cells and populations having the marker integrated into all of the population of transformed ABICyano1 cells. As depicted in FIG. 115, ABICyano1 clone TK616.5 is completely segregated whereas ABICyano1 clone TK616.4 is only partially segregated (about 80%).

In an embodiment, chromosomal integration of a construct resulted in the creation of an ABICyano1 strain auxotrophic for arginine. Chromosomal integrative plasmids were used to integrate a marker gene into the chromosome of ABICyano1 at the argH gene. As depicted in FIG. 116, PCR-based segregation analysis shows that an ABICyano1 organism transformed with construct TK597 (pOriVT_argH-up_FRT-PcpcB-Gm-ter-FRT_argH-down) successfully integrated an antibiotic resistance marker gene (Gm) into to the argH gene in the chromosome of ABICyano1. As depicted in FIG. 116 the auxotrophy for arginine of the ABICyano1 TK597 strains was tested by growing on a BG11 agarose plate lacking arginine. As depicted in FIG. 116, all of the auxotrophic clones cannot grow on the BG11 agarose plate lacking arginine whereas the wild-type ABICyano1 can grow.

Figure 117:
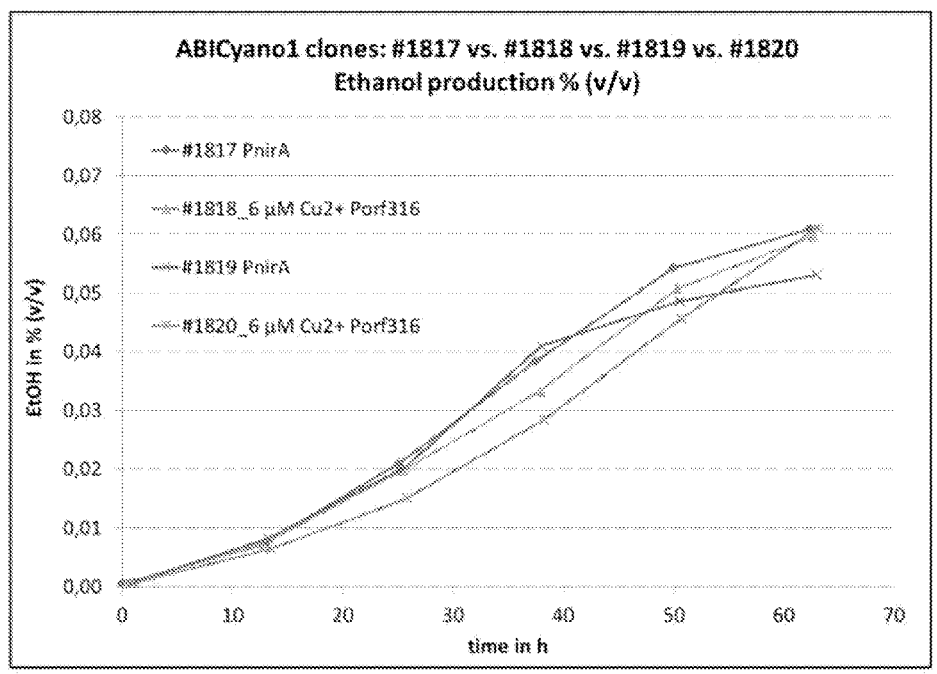
FIG. 117 depicts ethanol production of ABICyano1 strains whose ethanologenic capacity was created by homologous recombination using constructs #1817, #1818, #1819 and #1820.

In an embodiment, chromosomal integration of ethanologenic constructs into the chromosome of ABICyano1 resulted in ABICyano1 strains that produced ethanol. As depicted in FIG. 117 plasmids #1817, #1818, #1819, and #1820 were introduced into ABICyano1 host cells and chromosomal integration occurred via homologous recombination. The plasmid map of #1819 (pflv3::PnirA-zmPDC(opt1)_dsrA-Prbc*(optRBS)-synADH\oop-PcpcB-Gm**) (SEQ ID NO: 109) is depicted in FIG. 159. Then plasmid map of #1820 (pflv3::Porf0316-zmPDC(opt1)_dsrA-Prbc*(optRBS)-synADH\oop-PcpcB-Gm**) (SEQ ID NO: 110) is depicted in FIG. 160. Strains resulting from the integration events contained an exogenous ethanologenic cassette having an adh gene operably linked to a constitutive promoter Prbc*(optRBS) and having a pdc gene operably linked to either a nitrate inducible promoter PnirA (#1817 and #1819) or a copper inducible promoter Porf0316 (#1818 and #1820).

In an embodiment, a knockout of an ABICyano1 homolog of a recJ gene in is disclosed to increase the efficiency of homologous recombination in ABICyano1. In *Synechocystis* sp. PCC 6803 deletion of sll1354 (encoding for ssDNA-specific exonuclease recJ) increased the transformability with suicide constructs by two orders of magnitude (Kufryk et al., 2001). The gene sll1354 encodes for a 759 aa enzyme that is homologous to two RecJ proteins in ABICyano1. A first RecJ homolog is 30% identical to sll1354 and is 575 aa (SEQ ID NO: 125) encoded by orf0488 is (SEQ ID NO: 127). A second RecJ homolog is 25% identical to sll1354 and is 800 aa (SEQ ID NO: 126) encoded by orf2384 (SEQ ID NO: 128). In an embodiment, HR is improved in ABICyano1 by the deletion of orf0488 and/or orf2384. A knockout of orf2384 ("recJ2") from the genome of ABICyano1 was successful and is embodied in construct TK567.

In an embodiment, an integrative plasmid is TK539 (oriVT_flv3_up_PrbcL-Km_flv3_down), the plasmid map with annotation is depicted in FIG. 138** and sequence depicted in SEQ ID NO: 88.

In an embodiment, an integrative plasmid is TK541 (oriVT_flv3_up_PrbcL-Gm_flv3_down) the plasmid map with annotation is depicted in FIG. 139** and sequence depicted in SEQ ID NO: 89.

In an embodiment, an integrative plasmid is TK552 (oriVT_flv3_up_PcpcB-Gm_flv3_down) the plasmid map with annotation is depicted in FIG. 140** and sequence is depicted in SEQ ID NO: 90.

In another embodiment, an integrative plasmid is TK617 (oriVT_flv3_up_1kb_FRT-PcpcB-Gm-tB0014-FRT-flv3_down_1kb) the plasmid map with annotation is depicted in FIG. 141** and the sequence is depicted in SEQ ID NO: 91.

In yet another embodiment, an integrative plasmid is TK618 (oriVT_flv3_up_2kb_FRT-PcpcB-Gm_tB0014-FRT-flv3_down_2kb) the plasmid map with annotation is depicted in FIG. 142** and the sequence is depicted in SEQ ID NO: 92.

In an embodiment, an integrative plasmid is TK619 (OriVT_flv3_up_3kb_FRT-PcpcB-Gm_ter-FRT-flv3_down_3kb) the plasmid map with annotation is depicted in FIG. 143** and the sequence is depicted in SEQ ID NO: 93.

In an embodiment, an integrative plasmid is TK572 (oriVT_recJ_up_FRT-PcpcB-Gm-tB0014-FRT_recJ_down) the plasmid map with annotation is depicted in FIG. 144** and the sequence listing is depicted in SEQ ID NO: 94.

In an embodiment, an integrative plasmid is TK567 (oriVT_recJ2_up_FRT-PcpcB-Gm-tB0014-FRT_recJ2_down) the plasmid map with annotation is depicted in FIG. 145** and the sequence listing is depicted in SEQ ID NO: 95.

In an embodiment, an integrative plasmid is TK596 (oriVT_narB_up_FRT-PcpcB-Gm-tB0014-FRT_narB_down) the plasmid map with annotation is depicted in FIG. 146** and the sequence listing is depicted in SEQ ID NO: 96.

In a certain embodiment, an integrative plasmid is TK597 (oriVT_argH_up_FRT-PcpcB-Gm-tB0014-FRT_argH_down) the plasmid map with annotation is depicted in FIG. 147** and the sequence listing is depicted in SEQ ID NO: 97.

In an embodiment, an integrative plasmid is TK598 (oriVT_leuB_up_FRT-PcpcB-Gm-tB0014-FRT_leuB down) the plasmid map with annotation is depicted in FIG. 148** and the sequence listing is depicted in SEQ ID NO: 98.

In an embodiment, an integrative plasmid is TK616 (oriVT_ycf37_up_FRT-PcpcB-Gm-tB0014-FRT_ycf37_down) the plasmid map with annotation is depicted in FIG> 149** and the sequence listing is depicted in SEQ ID NO: 99.

Kits for Producing Compounds of Interest

In an embodiment, a kit for producing a compound of interest using genetically enhanced ABICyano1 host cells includes genetically enhanced ABICyano1 host cells, a vessel for culturing the host cells and a means for illumination of the host cells. In an embodiment, the host cells of the kit produce ethanol and the means for illumination is photosynthetically active radiation from the sun. In an embodiment, the means for illumination of the host cells include lamps or light emitting diodes or a combination thereof. The vessel of the kit can be a photobioreactor which is at least partly transparent for the radiation emitted by the means for illumination of the host cells. In particular embodiments, any of the photobioreactors disclosed in the PCT application WO 2008/055190 A2, which is hereby incorporated in its entirety by reference, can be used.

Furthermore the kit also can also include means for separating the compound, preferably ethanol from the growth medium as, for example, disclosed in the PCT application WO2011/103277 A1, which is hereby incoiporated in its entirety by reference.

ABiCyano1 Free from Antibiotic Resistance Genes

In certain strains of genetically enhanced cyanobacteria, antibiotic resistance genes are paired with inserted genes of interest in order to improve the genetic stability of the inserted gene when an antibiotic is present in the medium. It would be beneficial, however, to be able to construct a stable, genetically enhanced *Cyanobacterium* sp. ABICyano1 strain that does not contain an antibiotic resistance gene, and does not require the presence of the corresponding antibiotic in order to maintain the inserted genes.

In an example, a genetically enhanced ethanologenic *Cyanobacterium* sp. ABICyano1 that is free of antibiotic resistance genes is prepared. The construction of an antibiotic-resistance-cassette free strain is based on the inactivation of an essential gene (e.g. argH) or a conditionally essential gene (e.g. narB) located on the chromosomal DNA, and its replacement on the plasmid that carries the inserted genes of interest.

In a more specific example, the construction of an antibiotic-resistance-cassette free strain is based on the inactivation of the endogenous (conditionally) essential genes, narB and argH, which are both located on the chromosomal DNA, and then placing a functional narB or argH gene on the extrachromosomal plasmid that contains the ethanol cassette (or other inserted gene of interest). Essentially, this results in the functional narB or argH gene being relocated from the chromosomal DNA to the recombinant plasmid.

Because the argH and narB gene products are (conditionally) essential for the survival of the cell, the presence of the plasmid that the argH or narB gene has been moved to also becomes essential for the survival of the cell. This is a way of preserving the extrachromosomal plasmid (and any genes it carries) without the need of using antibiotics in the medium. This method is particularly useful for commercial scale growth of a given strain.

In one illustrative embodiment, the method involves the following steps: the location of the argH and narB gene is identified in the ABICyano1 genome. The greater than 2000 kb upstream and downstream flanking regions of the argH and narB gene are identified. A DNA fragment for the knock-out of argH or narB is prepared, having the greater than 2,000 kb upstream region of the narB or argH gene; the sacB cassette or the galK gene driven by a suitable inducible promoter, a gentamycin resistance gene driven by a suitable promoter, and a greater than 2,000 kb downstream region of the narB or argH gene as well as oriVT enabling replication in *E. coli* and conjugative transfer. This construct introduced to *Cyanobacterium* sp. ABICyano1 by conjugation. Successful transformants will contain a sacB/Gm or galK/Gm fragment in place of the original narB or argH gene.

Additionally, the cells have also been transformed with an extrachromosomal plasmid having 1) a functional narB or argH gene and 2) the ethanol cassette genes.

The transformed cells are grown on increasing amounts of gentamycin in order to select for transformed cells where all wild-type copies of the nail or argH gene are completely absent and replaced by the mutated gene copy version. The step of growth on high amounts of antibiotic is repeated as needed until a cell is selected that has no chromosomal copies of the original narB or argH gene.

Subsequently, in order to remove the gentamycin resistance gene and the counter-selectable marker sacB or galK gene, the following method can be used. The sacB gene encodes the enzyme levansucrase from Bacillus subtilis that confers sucrose sensitivity on gram-negative bacteria such as cyanobacteria. SacB is lethal to the cyanobacterial cells in the presence of sucrose. This causes any cells having the gene sacB to die in the presence of sucrose. Thus, by adding sucrose to the sacB/Gm transformed cells, and then selecting for surviving cells, one can select for cells that have lost the sacB/Gm cassette. In another embodiment, if galK is used as a counter-selection marker which encodes the galactokinase gene from E. coli and confers sensitivity to 2-deoxy-galactose (2-DOG) on gram-negative bacteria such as cyanobacteria. GalK is lethal to the cyanobacterial cells in the presence of 2-DOG. This causes any cells having the gen galK to die in the presence of 2-DOG. Thus, by adding 2-DOG to the galK/Gm transformed cells and then selecting for surviving cells, one can select for cells that have lost the galK/Gm cassette Resulting cells would have the narB/ethanol cassette or argH/ethanol cassette located on the extrachromosomal plasmid, but would not contain sacB or galK, an antibiotic resistance gene, or the original (chromosomally located) narB or argH gene.

By use of this and related methods, genetically enhanced, ethanol producing cyanobacterial cells are obtained that do not have antibiotic resistance genes, and that also maintain the ethanol cassette without the need for antibiotics. Further essential or conditionally essential genes whick can be applied alternatively to narB and argH to create antibiotic free cells include leuB, pyrF, nirA and ggpS; narB, nirA and ggpS are conditionally essential genes while leuB and pyrf are essential genes.

ABICyano1 p6.8 Derived Plasmids

In an embodiment, #1658 (pABIcyano1-PnirA2-zmPDC(opt3)-dsrA-Prbc(optRBS)-synADHoop) whose plasmid map is depicted in FIG. 118 (SEQ ID NO: 72) is a plasmid useful for production of compounds of interest in ABICyano1.

In another embodiment, #1663 (pABIcyano1-PnirA*4-zmPDC(opt3)-dsrA-Prbc*(optRBS)-synADHoop) whose plasmid map is depicted in FIG. 119 (SEQ ID NO: 73) is a plasmid useful for production of compounds of interest in ABICyano1.

In another embodiment, #1697 (pABIcyano1-PnirA*3-zmPDC(opt3)-dsrA-Prbc*(optRBS)-synADHoop) whose plasmid map is depicted in FIG. 120 (SEQ ID NO: 74) is a plasmid useful for production of compounds of interest in ABICyano1.

In an embodiment, #1932 (pABIcyano1PnirA*2-zmPDC(opt3)\dsrA-PcpcB-ADH111(opt)_trbcS) whos plasmid map is depicted in FIG. 150 (SEQ ID NO: 100) is a plasmid useful for production of compounds of interest in ABICyano1.

In another embodiment, #1933 (pABIcyano1-PnirA*2-zmPDC(opt3)\dsrA-PcpcB-Adh916(opt)_trbcS) whose plasmid map is depicted in FIG. 151 (SEQ ID NO: 101) is a plasmid useful for production of compounds of interest in ABICyano1.

In an embodiment, #1934 (pABIcyano1-PnirA*2-zmPDC(opt1)\dsrA-PcpcB-ADH1520(opt)_trbcS) whose plasmid map is depicted in FIG. 152 (SEQ ID NO: 102) is a plasmid useful for production of compounds of interest in ABICyano1.

In yet another embodiment, #1935 (pABIcyano1-Porf0316-zmPDC(opt3)\dsrA-PcpcB-ADH111(opt)_trbcS) whose plasmid map is depicted in FIG. 153 (SEQ ID NO: 103) is a plasmid useful for production of compounds of interest in ABICyano1.

In an embodiment, #1936 (pABIcyano1-Porf0316-zmPDC(opt3)\dsrA-PcpcB-Adh916(opt)_trbcS) whose plasmid map is depicted in FIG. 154 (SEQ ID NO: 104) is a plasmid useful for production of compounds of interest in ABICyano1.

In another embodiment, #1937 (pABIcyano1-Porf0316-zmPDC(opt1)\dsrA-PcpcB-ADH1520(opt)_trbcS) whose plasmid map is depicted in FIG. 155 (SEQ ID NO: 105) is a plasmid useful for production of compounds of interest in ABICyano1.

Optimized Promoters

Figure 123:
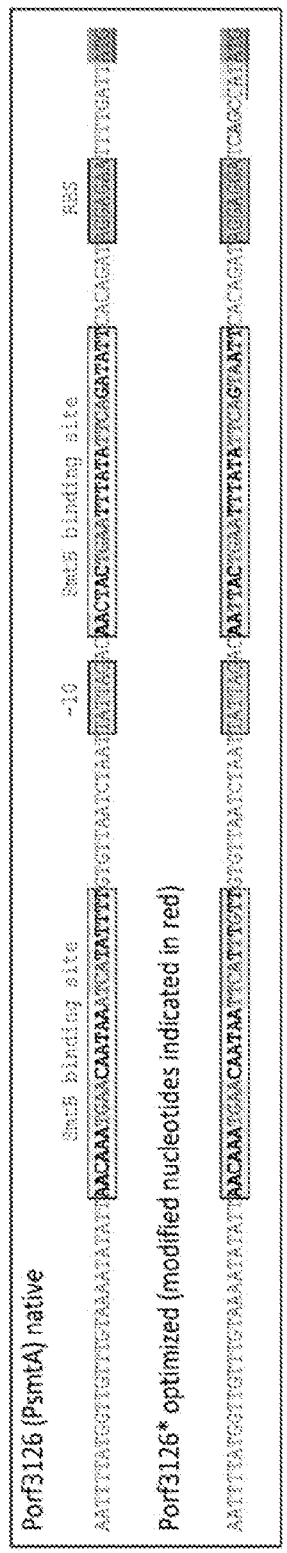

In an embodiment, copper-promoter variants with improved RBS are depicted in FIG. 121. In another embodiment, copper-promoter variants with improved −10 region (Pribnow box) are depicted in FIG. 122. In yet another embodiment, optimized Porf3126 (PsmtA) derived from ABICyano1 is depicted in FIG. 123.

PDC Activity in Zinc-Inducible Strains

Figure 124:
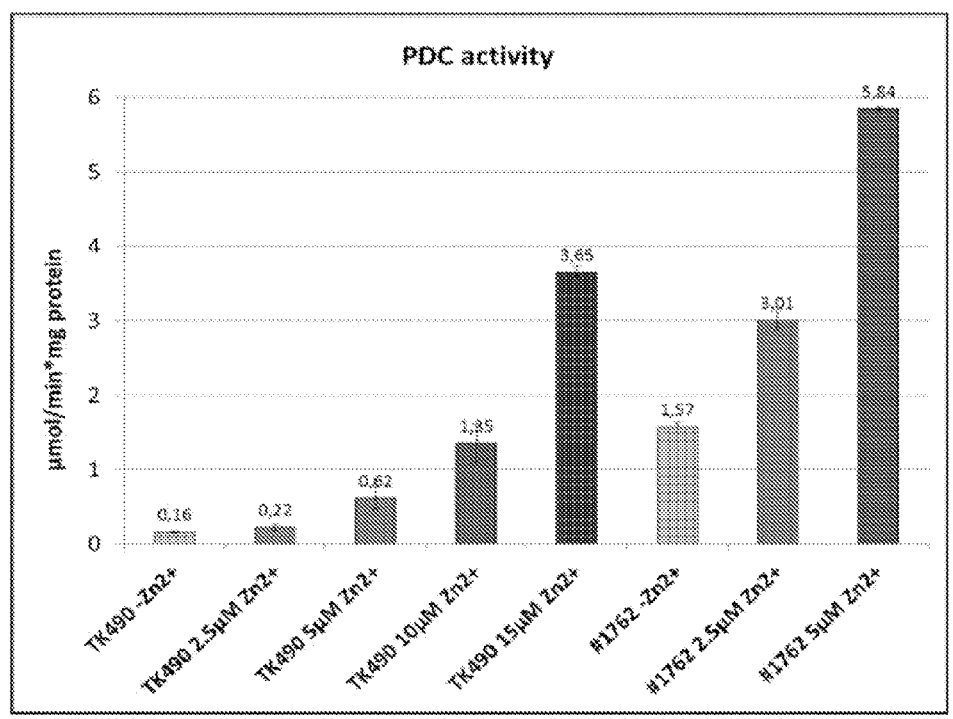
Figure 126:
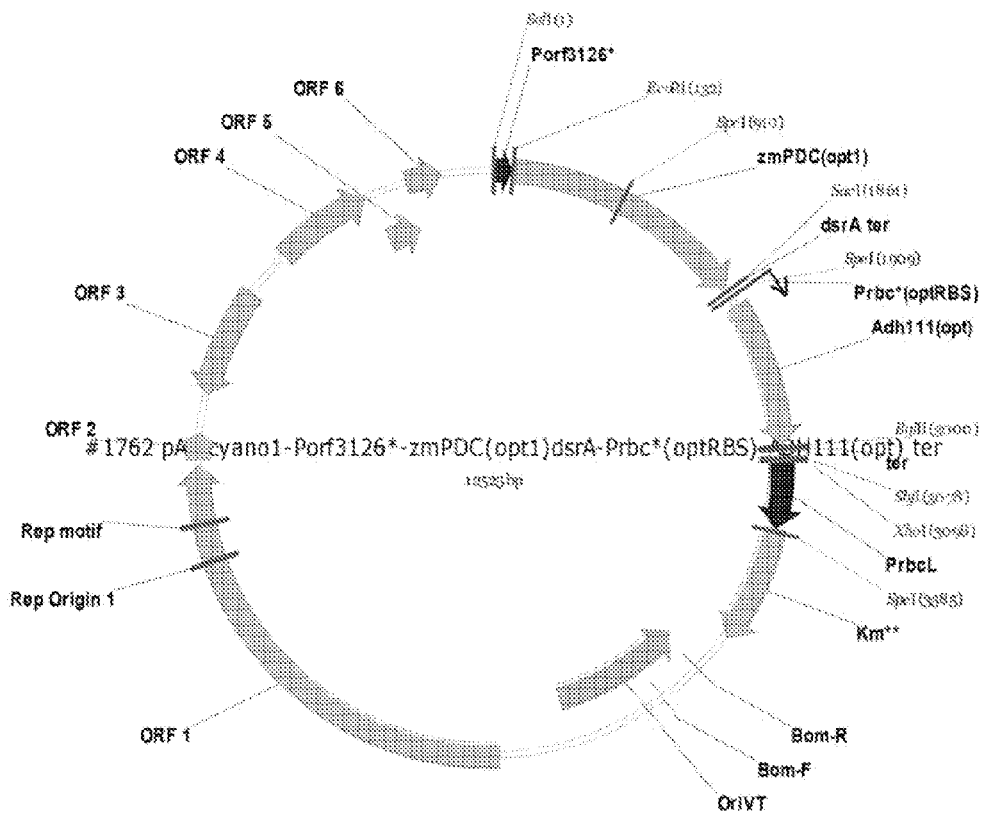
Figure 127:
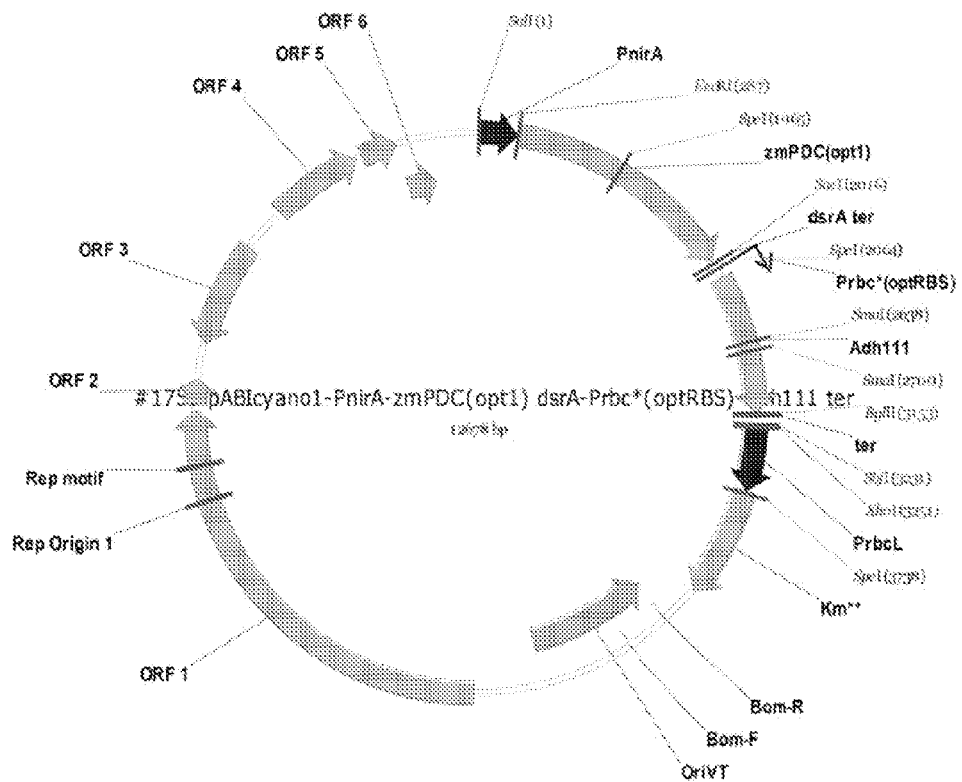

In an embodiment, and as depicted in FIG. 124, PDC activity in $Zn^{2+}$ induced ABICyano1 strains TK490 and #1762 was measured. In an embodiment, ABICyano1 strain #1762 (pABIcyano1-Porf3126*-zmPDC(opt1)dsrA-Prbc*(optRBS)-ADH111(opt)\ter) whose plasmid map with annotations is depicted in FIG. 126 (SEQ ID NO: 76) comprises an improved variant of the native zinc-inducible orf3126 promoter that exhibits substantially higher PDC activity compared to the strain TK490 comprising the native orf3126 promoter. When induced with 5 μM zinc, strain TK490 exhibits PDC activity of 0.62 μmol/mg*min while in strain #1762, the PDC activity is 5.8 μmol/mg*min which is about 10-fold greater due to the use of the improved Porf3126* variant with introduced nucleotide changes within both smtB binding sites and the RBS as depicted in FIG. 123. A plasmid map of #1753 (pABIcyano1-PnirA-zmPDC(opt1)_dsrA-Prbc*(optRBS)-Adh111_ter) with sequence annotation is depicted in FIG. 127 (SEQ ID NO: 77).

The present disclosure is further described by the following non-limiting examples. However, it will be appreciated that those skilled in the art, on consideration of this disclosure, may make modifications and improvements within the spirit and scope of the present disclosure.

EXAMPLES

Example 1: Bacterial Strains, Growth Conditions, and Selection of Transformants

E. coli strains HB101 (Promega), XL10-Gold (Stratagene), and α-select (Bioline) were grown in Luria-Bertani (LB) medium at 37° C. Ampicillin (50 μg/mL), kanamycin (50 μg/mL), and chloramphenicol (34 μg/mL) were used when appropriate. Cultures were continuously shaken overnight at 200 rpm and at 100 rpm when used for conjugation. ABICyano1 was cultured at from 28° C. to 37° C. in liquid BG11 fresh water medium on a reciprocal shaker at 150 rpm under continuous illumination of approximately 30-40 μmol photons*$m^{-2}$*$sec^{-1}$.

Unless otherwise noted, the ABICyano1 transformants were selected on solid BG11 medium containing 10-20 μg/mL kanamycin and were maintained on BG11 plates containing 40 μg/mL kanamycin. For growth in liquid freshwater BG11 medium, 30-40 μg/mL of kanamycin was applied.

Plasmid DNA from E. coli strains was isolated using a GeneJet Plasmid Miniprep Kit (Fermentas) according to the manufacture's protocol. For plasmid isolation from putative ABICyano1 transformants, total DNA was prepared according to Saha et al. (2005), World Jour. Microbiol Biotechnol 21:877-881.

For plasmid rescue from putative ABICyano1 transformants, total DNA was isolated and transformed in both a-select and XL10-Gold. *E. coli* colonies were selected for kanamycin resistance, DNA was isolated from single colonies and analyzed by PCR and restriction analysis for the presence of the correct plasmid. In particular, the endogenous plasmid of ABICyano1 was captured with the EZ-Tn5 (R6Kγori/KAN-2) Tnp Transposome kit (Epicentre, Madison, Wis.) by following the protocol provided by the manufacture. The rescued clones were amplified in TransforMax™ EC100D™ pir-116 electro-competent *E. coli* host cells (Epicentre, Madison, Wis.). Plasmid DNA was prepared with Qiagen plasmid Maxi kit (Qiagen Inc., Valencis, Calif.). Approximately 8 to 16 rescued clones were selected for sequencing via the conventional Sanger sequencing protocol. Protein-coding genes from each of the plasmids were predicted with the gene finder Glimmer (Delcher AL, Bratke KA, Powers EC, & Salzberg SL (2007) Identifying bacterial genes and endosymbiont DNA with Glimmer. *Bioinformatics* 23(6):673-679) version 3.02, followed by BLAST against the NCBI NR database.

Example 2: Preparation of Cyanobacterial Culture Medium

BG-11 stock solution was purchased from Sigma Aldrich (Sigma Aldrich, St. Louis, Mo.). Stock solutions of the antibiotics spectinomycin (100 mg/mL) and kanamycin (50 mg/mL) were purchased from Teknova (Teknova, Hollister, Calif.). Stock solution of the antibiotic gentamycin (10 mg/mL) was purchased from MP Biomedicals (MP Biomedicals, Solon, Ohio). Marine BG-11 (mBG-11) was prepared by dissolving 35 g Crystal Sea Marinemix (Marine Enterprises International, Inc., Md.) in 1 L water and supplementing with BG-11 stock solution. Vitamin $B_{12}$ (Sigma Aldrich) was supplemented to mBG-11 to achieve a final concentration of 1 μg/L, as needed.

Example 3: Ethanol Tolerance of ABICyano1

ABICyano1 strain was tested to determine its tolerance to the presence of ethanol in the culture medium, in comparison to two publicly available strains, *Synechocystis* PCC 6803 and *Synechococcus* PCC 7002. The cells were cultured in 100 mL Erlenmeyer flasks with 50 mL. culture volume in marine BG11 media (35 psu). Ethanol was added to the cultures to obtain a concentration of 1% (v/v) ethanol. The cultures were examined weekly for cell viability and remaining ethanol concentration. At each of the weekly samplings, the ethanol level was replenished as needed in order to maintain the 1% (v/v) ethanol concentration. The cells were also examined using a microscope (light microscope, phase contrast, autofluorescence). If more than 50% of cells were intact the test was continued. Cyanobacterial cells were deemed to be intact if cell morphology did not change significantly upon addition of ethanol, the cells were still green, and cells were not lysed after addition of ethanol. The number of weeks that each of the strains remained at least 50% viable in the cultures spiked with 1% ethanol was determined. Growth for at least 8 weeks is considered to be a positive screening result. The results indicate that *Synechocystis* sp. PCC 6803 can withstand at least 1% ethanol in the medium for 3 weeks, that *Synechococcus* sp. PCC 7002 can withstand at least 1% ethanol in the medium for 13 weeks and that *Cyanobacterium* sp, in particular ABICyano1, can withstand at least 1% ethanol in the medium for at least 16 weeks.

Example 4: Temperature Tolerance of ABICyano1

Wild type ABICyano1 was tested to determine its ability to grow at various temperatures. The initial starting cultures (50 mL in an Erlenmeyer flask) were grown under standard growth conditions (continuous 28° C. and light). The cultures were diluted to a chlorophyll content of about 5 μg/mL. The temperature changes during the assay were made without any prior temperature adaptation of the cultures. All tests were performed in marine media in a day/night cycle (14/10 h) for temperature (test depending) and light intensity (40 μmolE $m^{-2}sec^{-1}$ or darkness). The temperature tolerance tests were performed with increasing temperature profiles: maximum peak of 2 h at 45° C., 48° C., 50° C., 53° C. 55° C. and a day/night difference of 18° C. Each temperature profile (45° C., 48° C., 50° C., 53° C. and 55° C.) was run for 7 days. Cultures were sampled on days 0, 2, 5 and 7 with determination of $OD_{750}$ of possible) and chlorophyll. If a strain was grown under one temperature profile, the culture was diluted to same starting chlorophyll content and directly tested in the next higher temperature profile. An increase in chlorophyll content was used as the growth indicator. As depicted in Table 1, the results of the test indicate that ABICyano1 can tolerate culturing conditions of at 48° C., 50° C., and at least 53 to 55° C. for at least two hours over a period of time of at least 7 days.

The growth of wild type ABICyano1 was compared with *Synechococcus* PCC 7002 to elucidate its ability to grow in a photobioreactor environment while under extreme temperature fluxuations. Cultivation of ABICyano1 was performed in 0.5 L round photobioreactor (PBR) glass vessels (Schott) with implemented ports for sampling, in and out gas tubing, and pH as well as oxygen sensors. Mixing was via a magnetic stir bar, pH is controlled via $CO_2$ inflow. The oxygen and pH sensors are connected to an oxygen and pH measurement box (Crison Instruments, SA), and the gas flow is controlled by mass flow controller system (Vögtlin Instruments). All parameters (oxygen, temperature, gas flow, pH) are controlled and monitored using a computer software programmed by HTK Hamburg. The system temperatures of the PBRs were set to be comparable to the temperature profiles used in the temperature tolerance test, the results of which are depicted in Table X, with maximum temperatures of 45° C., 50° C. and 55° C. as compared to the standard PBR growth temperature of 37° C. Each temperature profile was run on an experimental culture for 7 days. Culture sampling was performed three times per week and $OD_{750}$, chlorophyll content and protein content were measured. At the beginning and at the end of each week, the dry weight of the accumulated biomass was determined. If a strain survived a given temperature profile, the culture was diluted to the same starting condition (chlorophyll content of about 10 μg/mL) and the next higher temperature profile was tested.

As depicted in FIG. 2, ABICyano1 is able to grow well at high temperatures, as compared to other genera, such as *Synechococcus* PCC 7002.

Example 5: Oxygen Tolerance of ABICyano1

ABICyano1 cells containing a recombinant pdc gene under the transcriptional control of $P_{nirA}$ and a recombinant Synadh gene under the control of $P_{rpsL}$ ($P_{rpsL}$ is the promoter of the 30S ribosomal protein S12) were grown in mBG11 medium. Cells were diluted to a starting OD of approximately $OD_{750}=1$. Cells were cultivated in 500 mL photobioreactors, round vessels with a 9.5 cm diameter. PBRs were illuminated with day/night cycle of 12 h/12 h from two sides with fluorescent tubes. The light intensity was approximately 400 μE $m^{-2}s^{-1}$ from each side. Temperature followed the day/night cycle with 37° C. during the illumination phase and 28° C. during the night. Cultures were constantly mixed with a magnetic stirrer with 450 rpm. $CO_2$ was supplied and regulated by monitoring pH (on/off modus); pH was maintained at 7.3±0.05 by computer-controlled supply of $CO_2$ (as 5% (v/v) $CO_2$ in air) into the medium. Growth medium was mBG11.

Three PBRs were run in parallel. The PBRs were purged with three different oxygen/nitrogen mixtures with a flow rate of 100 mL min$^{-1}$ during the illumination period. During the night phase, gas was not supplied to the PBR. The mixtures of oxygen and nitrogen (here given in percent oxygen (v/v)) were obtained with computer-controlled mass flow meters. The actual oxygen concentration in the medium was measured online with optical oxygen sensors and a multi-channel fiber optic oxygen transmitter (OXY-4 mini; PreSens). In contrast to Clark-type oxygen electrodes, this setup allows the measurement of very high oxygen concentrations.

At different time points samples were taken and analyzed for (i) ethanol and acetaldehyde in the medium, (ii) Absorbance at $OD_{750}$, (iii) chlorophyll content and (iv) total protein. Chlorophyll content and total protein were measured as in Tandeau De Marsac, N. and Houmard, J. in: Methods in Enzymology, Vol. 169, 318-328. L. Packer, ed., Academic Press, 1988, which is hereby incorporated by reference. In order to characterize the energy metabolism of the cells, the oxygen production rates in the light and the oxygen consumption rate in the dark were also measured. A Clark-type electrode (Rank brothers, diameter 1 cm) was used. Cells were diluted with mBG11 to 5 to 10 µg chlorophyll/mL, $NaHCO_3$ was added to 5 mM. Temperature was adjusted to 37° C. Illumination was with a slide projector H50 (Pentacon). For the measurement of P/I curves, light intensities were adjusted by varying the distance between projector and electrode.

The cultures of ABICyano1 cells containing a recombinant pdc gene under the transcriptional control of $P_{nirA}$ and a recombinant Synadh gene under the control of $P_{rpsL}$ were purged with gas mixtures containing 21%, 70% and 80% (v/v) oxygen in nitrogen. Twenty one percent oxygen in nitrogen corresponds to air. Purging the cultures with 21% oxygen resulted in an oxygen concentration in the growth medium of approximately 200 µmol/L. Purging the cultures with 70% oxygen resulted in oxygen concentration of greater than 650 µmol/L during the day period and greater than 300 µmol/L during the "night". Purging the cultures with 80% oxygen resulted in a reading during the day of greater than 900 µmol/L (in some cases greater than 1000 µmol/L) and greater than 600 µmol/L during the "night". The higher oxygen concentrations in the growth medium are caused by an increased oxygen production through photosynthesis.

The growth rates for the parameters of absorbance at $OD_{750}$, ethanol production rates, and chlorophyll content were calculated. The results are summarized in table 10. For these calculations, the measured data were fitted to a regression line, and the slope was used to calculate the increase per 24 h. The quantitative analyses depicted in table 5 shows that even for the high oxygen concentrations of 70 and 80% oxygen, the decrease in ethanol production and growth in ABICyano1 was small.

TABLE 10

|  | 21% oxygen | 70% oxygen | 80% oxygen |
|---|---|---|---|
| Ethanol | 0.0236%/d | 0.0202%/d | 0.0213%/d |
|  | 100% | 85% | 90% |
| Growth | 0.614 $OD_{750}$/d | 0.583 $OD_{750}$/d | 0.581 $OD_{750}$/d |
|  | 100% | 95% | 95% |
| Chlorophyll | 3.446 Chl/d | 2.878 Chl/d | 2.791 Chl/d |
|  | 100% | 84% | 81% |

ABICyano1 growth and ethanol production were compared to *Synechococcus* PCC 7002 growth and ethanol production. As with ABICyano1, *Synechococcus* PCC 7002 was transformed with a recombinant pdc gene under the transcriptional control of $P_{nirA}$ and a recombinant Synadh gene under the control of $P_{rpsL}$. In contrast to ABICyano1, significant effects on ethanol production, cellular growth and chlorophyll content were found for the recombinant *Synechococcus* PCC 7002 strain when purged with the different oxygen concentrations. Table 11 shows that purging with 80% oxygen decreased the ethanol production rate by 28%, decreased cell growth by 36%, and decreased chlorophyll content by 51%, during the course of the experiment. A comparison of tables 10 and 11 shows that the adverse effect of high oxygen concentrations on *Synechococcus* PCC 7002 growth, ethanol production and chlorophyll is significantly greater than for ABICyano1.

TABLE 11

|  | 21% oxygen | 70% oxygen | 80% oxygen |
|---|---|---|---|
| Ethanol | 0.00646%/d | 0.00499%/d | 0.00466%/d |
|  | 100% | 77% | 72% |
| Growth | 0.959 $OD_{750}$/d | 0.797 $OD_{750}$/d | 0.612 $OD_{750}$/d |
|  | 100% | 83% | 64% |
| Chlorophyll | 3.710 Chl/d | 2.455 Chl/d | 1.800 Chl/d |
|  | 100% | 66% | 49% |

The above results show that ABICyano1 is less sensitive to oxygen, than the ethanol producing *Synechococcus* PCC 7002, which was tested in parallel under comparable conditions. For the latter strain 70% (v/v) oxygen in nitrogen was sufficient to significantly inhibit growth and ethanol production.

Example 6: Transformation of ABICyano1 with p6.8 kb Based Shuttle Vector

The endogenous 6.8 kh plasmid of ABICyano1 can be used as a means of shuttling exogenous DNA to cyanobacterial host cells. By inserting an origin of replication that is effective in *E. coli* (such as R6KOri), the p6.8 kh plasmid DNA can be manipulated in bacteria, such as *E. coli* to incorporate genes and sequences of interest into a recombinant p6.8 kb. For example, modifications to decrease the effectiveness of endogenous restriction systems that are present in ABICyano1, such as methylation, can be performed.

The presence of an origin of replication that is already on ABICyano1 can assist with replication of the recombinant p6.8 kb once it is transferred into a host cell. Multiple cloning sites can be added to allow for several different antibiotic resistance genes to be added, if desired. Multiple cloning sites can also be inserted to allow for ease of insertion of various expression cassettes, such as the pdc/adh gene cassette for ethanol production. In this way, various sequence segments of the plasmid can be replaced with other sequence segments as needed.

Example 7: Detection of Endogenous Restriction Endonucleases in ABICyano1

Restriction endonucleases (RENs) expressed by cyanobacteria can be a major barrier for successful transformation of cyanobacterial host cells. Accordingly, the presence of RENs in ABICyano1 has been analyzed. Bioinformatic analyses predicted the following RENs for ABICyano1: HgiDI (AcyI), AvaI, AvaIII, BstEII, and HpaII. Prediction of RENs was conducted by comparing a query set of all the encoded amino acid (AA) sequences in the ABICyano1 draft genome against the REBASE, restriction enzyme database maintained by the New England Biolabs (NEB) using the basic local alignment search tool (BLAST). Significant hits were pooled and manually examined for the presence of restriction-modification motifs using bioinformatic analyses including BLAST against NR (ncbi.nlm.nih.gov/blast/blast_databases.shtml), PFam (pfam.sanger.ac.uk/) and SMART (smart.embl-heidelberg.de/). These bioinformatically predicted RENs were further verified through biochemical assay of crude cellular extract of ABICyano1.

Lane 3 of FIG. 55, depicts that plasmids intended for transformation were cleaved by a crude extract of ABICyano1. In order to improve the efficiency of a transformation protocol, protection against the damaging effects of RENs was needed. This was achieved by methylation using the commercial CpG methylase M.SssI, the results of which are depicted in FIG. 55, lane 4.

Crude extract from ABICyano1 was prepared as follows: 50 mL of liquid pre-culture was inoculated to an $OD_{750nm}$ 0.5-1. After growth for 10 days, 30 mL of the ABICyano1 culture of was pelleted (5 minutes at 3000×g at room temperature), washed once with lysis buffer (40 mM sodium hydrogenphosphate pH 7.4, 1 mM EDTA, 5% (v/v) glycerol) and resuspended in 1 mL lysis buffer. ABICyano1 cells were disrupted by glass beads using a tissue lysis apparatus at full speed for 4 minutes. The supernatant was then withdrawn and centrifuged twice at 14000×g at room temperature. One U of RNase per mL was added to the final supernatant. Restriction analysis on plasmids followed by sequencing was used to determine the presence of RENs HgiDI (AcyI), and AvaI in the crude extract of ABICyano1.

Example 8: Competent ABICyano1 Cells for Transformation by Conjugation

Many cyanobacteria produce extracellular polymeric substances (EPS), however, the appearance and composition of the EPS layer are strain specific and dependent on environmental conditions. EPS can be associated to the cell surface or released to the surrounding medium (Pereira et al., 2009, FEMS Microbiol. Rev. 33:917-941). While the released substances can in some cases be easy to remove from being associated with the cyanobacterial cells, in other cases the EPS is difficult to remove.

ABICyano1 was stained with scribtol black (drawing ink for calligraphy, Pelican), which cannot penetrate EPS, to test for the presence of EPS. As depicted in FIG. 1B, staining of ABICyano1 cells with scribtol black resulted in a white/yellowish layer around the ABICyano1 cells indicating a lack of staining by scribtol black. Thus, FIG. 1B depicts micrographs of stained ABICyano1 cells showing that the EPS is attached to the cells. This layer may decrease the ability of the ABICyano1 cells to accept foreign DNA during the conjugation process for transformation.

After several unsuccessful attempts, the inventors were able to successfully transform the ABICyano1 cells after using methods to decrease the EPS layer. Thus, the following method was used to decrease the EPS layer prior to conjugation. The method involves several steps: treatment of cells with NAC, washing steps that utilize NaCl, treatment with lysozyme, and subsequent washing followed by a conjugation procedure.

Two hundred mL of an exponentially growing culture ($OD_{750nm}$ greater than about 0.5 and less than about 1.0) was incubated with NAC for 2 days at 16° C. (end concentration of NAC is about 0.1 mg/mL) without shaking. This pretreatment was followed by several steps to degrade the EPS and to weaken the cell wall. The pretreated culture was pelleted at 4400 rpm and washed with 0.9% NaCl containing 8 mM EDTA.

For further treatment with lysozyme, the cell pellet was resuspended in 0.5 M sucrose and incubated 60 min at room temperature (RT) with slow shaking (85 rpm). Then, cells were centrifuged and resuspended in 40 mL of a solution containing 50 mM Tris (pH 8.0), 10 mM EDTA (pH 8.0), 4% sucrose, and 20-40 µg/mL lysozyme. After incubation at rt for 10-15 min, cells were centrifuged and washed three times using different washing solutions; i) 30 mM Tris containing 4% sucrose and 1 mM EDTA; ii) 100 mM Tris containing 2% sucrose and iii) with BG11 medium. All centrifugation steps before lysozyme treatment were performed at 4400 rpm for 10 min at 10° C. All centrifugations after the lysozyme treatment were performed at 2400 rpm for 5 mM at 4° C. Resuspended cells were used for conjugation.

Example 9: Transformation of ABICyano1 by Conjugation

Gene transfer to ABICyano1 was performed using conjugation. Generated plasmids containing oriVT were used for conjugation. The shuttle vectors were transformed into ABICyano1 following a modified conjugation protocol which includes the pretreatment of ABICyano1 to reduce its EPS layer as described in example 17.

Triparental mating was performed as follows: E. coli strain J53 hearing a conjugative RP4 plasmid and E. coli strain HB101 bearing the cargo to be introduced into ABICyano1 and the pRL528 helper plasmid (for in vivo methylation) were used. E. coli strains were grown in LB broth supplemented with the appropriate antibiotics overnight at 37° C. with shaking at 100 rpm An aliquot of 3-5 mL of each culture was centrifuged, washed twice with LB medium and resuspended in 200 µL LB medium. Subsequently, the E. coli strains were mixed, centrifuged and resuspended in 100 µL BG11 medium. Two hundred mL of exponentially growing cyanobacterial culture ($OD_{750nm}$ of greater than 0.5 and less than 1.0) was centrifuged (3000 rpm, 10 min), pretreated to degrade the EPS layer as described in example 17, and subsequently washed and resuspended in 400 µL BG11 culture medium containing Tris/sucrose buffer (example 17). A 100 µL aliquot of resuspended cyanobacterial and E. coli cultures was mixed and applied onto a membrane filter (Millipore GVWP, 0.22 µm pore size) placed on the surface of solid BG11 medium supplemented with 5% LB. Petri dishes were incubated under dim light (5 µE $m^{-2}s^{-1}$) for 2 days. Cells were then resuspended in fresh BG11 medium and plated onto selective medium containing 10 and 15 µg/mL kanamycin, respectively. The following selection conditions were used: light intensity of approximately 20-40 µE $m^{-2}s^{-1}$ at a temperature of approximately 28° C. Transformants were visible after approximately 7-10 days. The transformant colonies were then plated on BG11 media containing 15 µg/mL kanamycin and then transferred stepwise to higher kanamycin concentrations (up to kanamycin 60 µg/mL) to aid in the selection process.

Example 10: Transformation of ABICyano1 by Electroporation

Electroporation can also be used for successful transformation of ABICyano1 using, for example, the same plasmids as for conjugation, but with lower efficiency.

As with the conjugation transformation protocol (example 18), strain-specific adaptations of standard electroporation protocols need to be made to avoid DNA digestion by endogenous restriction enzymes and to allow DNA entry through the EPS layer. To achieve successful electroporation, DNA is protected against endogenous restriction enzymes by methylation. Prior to electroporation. ABICyano1 cells are pretreated with positively charged polyaminoacids such as poly-L-lysine hydrobromide or poly-L-ornithine hydrochloride or combinations thereof (in particular poly-L-lysine hydrobromide) in order to increase the DNA uptake efficiency.

As an example, one hundred mL of exponentially growing ABICyano1 cultures (corresponding to a cell density of approximately 2×10$^7$ cells/mL), were harvested, washed and resuspended in 0.9% NaCl containing 25 mM Tris-HCl (pH 8.0). Poly-L-lysine hydrobromide was added to the resuspended cells to obtain a final concentration of 50 µg/mL. ABICyano1 cells were then incubated for several hours or overnight before electroporation.

In a typical procedure, 50 mL of poly-L-lysine hydrobromide treated ABICyano1 cells were harvested and treated with 30 mL ice-cold BG11 containing 6% DMSO. After incubation on ice for 20 min, cells were harvested and frozen in liquid nitrogen for 15 min. These pre-frozen cells were thawed by adding 15 mL ice-cold buffer containing 1 mM HEPES (pH7.5), 0.2 mM $K_2HPO_4$ and 0.2 mM $MgCl_2$. The cells were washed sequentially once more with 1 mM HEPES and ETMT buffer containing 0.1 mM HEPES, 0.2 mM $K_2HPO_4$ and 0.2 mM $MgCl_2$. The cells were harvested by centrifugation at 15000×g for 5 min. All of the washes and centrifugations were carried out on ice or in a pre-chilled centrifuge (4° C.). For each electroporation procedure, 3 µg methylated DNA is added to 100 µL of concentrated cells. Cells were electroporated in a cuvette with a 2 mm gap between the electrodes and pulsed once in a Gene Pulse X-cell (Bio-Rad) using an exponential decay protocol (electric field strength of 8 kV/cm, capacitance of 25 µF, resistance of 400 ohms, for a time of approximately 8-9 ms). After electroporation, 1-2 mL BG11 medium was immediately added to the cyanobacterial suspension, which was subsequently transferred to a 50 mL flask containing 15 mL fresh BG11 medium. After incubation for 1-2 days under normal light (30-40 µE $m^{-2}s^{-1}$) with gentle shaking at 30° C., recovered cultures were centrifuged, resuspended in 500 µL BG11 medium and placed onto selective media (BG11 containing 20 µg/mL Km or 40-60 µg/mL of spectinomycin).

Example 11: Determination of Ethanol Production

GC headspace measurements were performed on a Shimadzu GC-2010 gas chromatograph with a flame ionization detector. The instrument is connected in-line with a Shimadzu PAL LHS2-SHIM/AOC-5000 autosampler. The autosampler has a gas-tight syringe for transfer of headspace aliquots from the culture samples to the analytical unit. Culture samples in the autosampler are illuminated from the bottom with a LED acrylic sheet equipped with a dimmer. Mixing of the samples in the autosampler is accomplished with the IKA RO5 power magnetic stirrer. A heating mat KM-SM3 of Mohr & Co in combination with the JUMO dTRON 316 temperature regulator is used for thermostatisation of the culture samples in the autosampler. The gas chromatograph uses helium as a carrier gas as well as hydrogen and artificial air as fuel gas and oxidizer gas, respectively, for the flame ionization detector. Oxidizer air is generated with the generator WGAZA50 from Science Support. The gas chromatograph is equipped with a FS-CS-624 medium bore capillary with a length of 30 m, internal diameter of 0.32 mm and film thickness of 1.8 µm from the GC supplier Chromatographie Service GmbH.

Sample preparation for GC headspace measurements was as follows. Hybrid clones were grown on BG11 plates containing inducing agent or without supplementation of the inducing agent. A sample was prepared by scratching an individual clone from the BG11 plate and resuspending the corresponding clone in mBG11 liquid medium. The addition of inducing agent triggered ethanol production in the sample by induction of the inducible promoter driving overexpression of the recombinant pdc and adh genes. The cell density in the sample was then adjusted to an optical density at 750 nm of approximately 0.7. Two mL of sample were then filled into a gas-fight GC vial for headspace autosampling with a nominal volume of 20 mL. The sample headspace was supplemented with 5 mL $CO_2$. The vial was tightly closed with a cap containing a self-sealing silicone septum and was then placed into the autosampler rack. The autosampler rack was temperature controlled at a given temperature, for example 37° C.

If necessary, reference samples can be prepared as 2 mL aliquots with 0.005, 0.01, 0.02, 0.05, 0.1, 0.2, 0.5, 1, 2, 5 and 10 mg/mL ethanol in 35 psu NaCl. Reference samples were placed into the same 20 mL sample containers with self-sealing silicon septum caps for headspace autosampling. For each reference sample, at least six measurements were applied. After the measurements, the resulting peak areas of the reference samples were used for generating two calibration curves, the first in the concentration range from 0.005 to 0.5 mg/mL ethanol and the second one for the concentration range from 0.5 to 10 mg/mL ethanol. The calibration curves were linear.

The sample incubation temperature in the autosampler was adjusted to a given temperature, for example 37° C. The illumination is set from about 90 µE $m^{-2}s^{-1}$ to about 150 µE $m^{-2}s^{-1}$. In an embodiment, the illumination was set to 120 µE $m^{-2}s^{-1}$. The magnetic stirrer was configured for interval mixing of the samples, with cycles of 2 min mixing at 400 rpm, followed by 90 minutes without mixing. An automated process follows wherein after given periods of time, aliquots of 500 µL of the headspace of the samples are automatically drawn from the headspace with a gas-tight syringe and injected via the injection port into the gas chromatograph for analysis. Before each headspace autosampling, the mixing is changed for 10 min to continuous mixing with 750 rpm at 37° C. incubation temperature. The syringe temperature was set at 70° C. The fill speed was 250 µL per second, following an initial lag time of 1 second after the septum of the samples has been pierced by the syringe needle. The injection of the aliquot into the gas chromatograph happens with an injection speed of 500 µL per second. Afterwards, the syringe flushes for 3 min with air to prevent sample carryover between two injections. The gas chromatograph runtime was 4 min and 30 s. The injection temperature on the gas chromatograph was 230° C. The column temperature was 60° C. Detection was accomplished with the flame ionization detector at 250° C. process temperature. The makeup gas was nitrogen at 30 mL per minute, the fuel gas is hydrogen at 35 mL per minute and the oxidizer gas is artificial air at 400 mL per minute.

After the final measurement, the final optical density at 750 nm of the samples was measured and an average cell density for each sample was determined by calculating the arithmetic mean of the optical density at the starting point and the optical density at the end point of the process. Afterwards, the average ethanol production rate per cell density was calculated.

Two kinds of measurements were performed, GC online measurements (applied for clone testing and short-term characterizations, and single GC measurements (applied for measurements of EtOH concentration of samples taken from PBR cultivations).

In a typical experiment for the quantitative determination of acetaldehyde and/or ethanol content in growth media by headspace gas chromatography (GC), the ethanol production of the respective cyanobacterial culture has to be induced 1-3 days prior to the GC measurement to trigger the overexpression of the pdc and Synadh production genes. For instance, to repress the $P_{nirA}$ (e.g. in TK225, TK293) hybrids were grown in mBG11 (artificial seawater) depleted of $NO_3^-$, with 2 mM Urea and 2 mM $NH_4Cl$. To induce the nirA promoter, cells were transferred prior to the GC measurement into mBG11 (artificial seawater salts) with nitrate. For GC measurements, cells were harvested from liquid cultures by centrifugation and then resuspended in the appropriate fresh marine medium ensuring that the induction conditions were maintained. The medium was further supplemented with 50 mM TES, pH 7.3 and 20 mM NaHCO$_3$. The sample was adjusted to an OD$_{750}$ of 0.7. Two mL samples were then aliquoted per 20 mL GC vial loaded with 3 mL pure CO$_2$. The tightly closed GC vials were placed onto an illuminated (120 µE m$^{-2}$s$^{-1}$ from the bottom) headspace auto sampler and were analyzed on the same day on a Shimadzu GC-2010 gas chromatograph equipped with a medium-bore capillary column (FS-CS-624, length 30 m; inner diameter 0.32 mm; film 1.8 µm) and a flame ionisation detector.

The culture was stirred once in an hour under constant light (approximately 120 µE m$^{-2}$s$^{-1}$) in GC vials (at 35° C.) on the GC sampling tray. Acetaldehyde and ethanol content were measured online at four different time points during 40 h to 48 h. Measurements could be extended to 72 h.

After completion of the GC measurements, the final OD$_{750}$ was determined and used to normalize the ethanol production rate according to the average OD$_{750}$ of the cyanobacterial sample. The average OD$_{750}$ was calculated as the arithmetic mean of the OD$_{750nm}$ at the time of sample preparation and the OD$_{750}$ after completion of the GC measurement.

FIG. 34 depicts the results of the ethanol quantitation. ABICyano1 containing TK293 produced a higher amount of ethanol (~0.02% (v/v)/OD*d) about 2-4 fold higher versus the production of ethanol when transformed with plasmids TK225.

The data generated for and depicted in table 9 includes the ethanol production data for various ABICyano1 strains. The third column shows the ethanol production rate as determined by a GC vial online assay. The fourth to sixth column show the ethanol production determined for 0.5 L Crison PBR, and for vPBR with different illumination intensities for a period of cultivation of 14 days or 21 days, respectively. These ethanol production data were determined with GC single measurements. The term "vPBR" indicates "vertical photobioreactors". The following procedure describes the standard lab conditions under which a 1.2 L vPBR is operating as well as the necessary parts, ports, etc. to construct this 1.2 L vPBR. The 1 column vPBR consists of an autoclavable polypropylene flexible film [Profol Kunststoffe GmbH; Germany] with the dimensions of 750 mm total height and a diameter of 50 mm when filled with liquid. The filling volume is about 1.2 L leading to a liquid height of about 620±20 mm and a headspace of about 150±20 mm. The vPBR is equipped with several ports for operation, located on specific positions of the vPBR from bottom to top: a sampling port (60 mm from the bottom). a gas$_{in}$ port (130 mm from the bottom), a pH probe port (300 mm from the bottom), DO$_2$ probe port (350 mm from the bottom), a medium$_{in}$ port (650 mm from the bottom) and a gas$_{out}$ port (700 mm from the bottom). The illuminated surface area when illuminated from one side is 0.049 m$^2$. The standard light conditions is a uniform light field from one side with 125 or 230 µmol µm$^{-2}$s$^{-1}$ at the vPBR surface generated by a light panel which consists of 9 to 12 T5 54W 6500K fluorescent bulbs operating in a 12/12 h day/night cycle. The temperature is set to 39° C. ±2° C. during day and 29° C. ±2° C. during night. The mixing is realized via the ascending air bubbles through the liquid culture. The gas flow is operating in a constant sparging mode (day and night) with air enriched with 15% CO$_2$ introduced on demand via pH control (pH setpoint=7.3, day and night) and a flow rate of 38 mL min$^{-1}$. The number of holes in the sparging tube for a 1.2 L vPBR is approx. 50 holes (perforated from both sides) and the sparging tube length is 220 mm. The standard cell density for starting a cultivation experiment OD$_{750nm}$=0.5 in mBG11 medium with 35 ppt (parts per thousand) salt (about 35 psu) (for strains that do not aggregate under high-light illumination). Table 9 depicts a list of plasmids for used for transformation of ABICyano1 with ethanologenic cassettes and also depicts ethanol production in ABICyano1 host cells created thereby.

Example 12: Determination of Ethanol Production Using Gas Chromatography

Two kinds of GC headspace measurements were performed:
a) GC online vial measurements (applied for clone testing and short-term characterizations of cultures cultivated in GC vials with a duration of up to 72 hours,
b) single GC single measurements (applied for measurements of EtOH concentrations in samples dayly taken from PBR cultures) by measuring the ethanol content after transferring 0.5 mL of the PBR cultures into GC vials after certain points of time of cultivation in the PBR. GC single measurements do not involve the cultivation of the strains in the GC vials. GC single measurements were performed in order to characterize the long term ethanol production of strains, which are already known to produce ethanol in sufficient quantities in GC online vial measurements. GC single measurements further differ from GC online vial measurements in the volume of the culture (2 mL in GC online vial and 0.5 mL aliquots taken from a PBR culture in GC single measurements). In single GC measurements only the absolute amount of ethanol produced at a certain point of time is determined, whereas the GC online vial measurements determines the course of ethanol production during a certain period of time up to 72 hours of growing the cells a GC vial under constant illumination. For GC single measurements the sample was heated to 60° C. in order to transfer all ethanol from the liquid phase to the gas phase for the GC headspace chromatography, which resulted in a disruption of the culture. In contrast to that this 60° C. heating step was omitted during GC online vial measurements in order not to destroy the culture and in order to further continue with the culturing of the cells in the GC vial. In the following GC online vial measurements are described.

GC Online vial headspace measurements are performed on a Shimadzu GC-2010 gas chromatograph with Flame Ionization Detector. The detection limit for ethanol quantification is at 0.0005%, but a calibration has to be done for detecting quantities below 0.001%. The instrument is connected in-line with a Shimadzu PAL LHS2-SHIM/AOC-5000 autosampler, comprising a gas-tight syringe for transfer of headspace aliquots from the culture samples to the analytical unit. Specific modifications were introduced as follows: Each sample tray is exposed with a LED acrylic sheet (length: 230 mm, wide: 120 mm, diameter: 8 mm, 24Chip, S4, 5300K) equipped with a dimmer by company Stingl GmbH. Below the sample tray a magnetic stirrer is installed (IKA RO 5 power) allowing for mixing of cultures which are cultivated in GC vials that stand in the sample tray. The sample trays are penetrating of maximum, so that the GC Vial stands in the Tray. A heating mat between LED acrylic sheet and the magnetic stirrer (MOHR &Co, one heating circuit, 230 V, 200 Watt, length: 250 mm, wide: 150 mm, diameter: ca. 2,5 mm) with a temperature regulator (JUMO dTRON 316) allows for the incubation of cultures in GC vials at specific temperatures. The gas chromatograph is connected to helium carrier gas as well as hydrogen and artificial air as fuel gas and oxidizer gas, respectively, for the flame ionization detector. Oxidizer air is generated with the generator WGAZA50 from Science Support. The gas chromatograph is equipped with a FS-CS-624 medium bore capillary with a length of 30 m, internal diameter of 0.32 mm and film thickness of 1.8 µm from the GC supplier Chromatographie Service GmbH.

The ethanol production in the culture has to be induced 1-2 days before the GC online vial experiment is realized by triggering the overexpression of Pdc and Adh. For induction hybrid cells are harvested from liquid cultures by centrifugation and are resuspended in a sterile tube with mBG11 media with additional 50 mM TES pH 7.3, 20 mM $NaHCO_3$, antibiotics and nitrate until they reached an OD of 2. For the hybrids with nirA promoter the induction is realized by transfer to nitrate containing medium. The clones were incubated on a small shaker at 180 rpm for 48 hours at 28° C. The shaker is aimed with a dimmable light table adjusted to 120 µE (300 µE-0 µE). After 48 h centrifuge the tube at 20° C. for 10 minutes, 4500 rpm and discard the supernatant. The Pellet is resuspended in mBG11 medium suppl. with 50 mM TES pH 7.3, 20 mM $NaHCO_3$, containing nitrate and no antibiotics. For hybrids under control of copper responsive promoters the induction is realized by addition of 3-6 µM copper, for zinc inducible promoters is the induction is realized by addition of 10 µM zinc sulfate (heptahydrate) and for hybrids with the peg promoter the induction is done by transfer to copper-free medium. The clones were incubated on a small shaker at 180 rpm for 24-48 hours at 28° C. The shaker is aimed with a dimmable light table adjusted to 120 µE (300 µE-0 µE). After 24 h-48 h cells were harvested by centrifugation in a 50 mL Falcon tube at 20° C. for 10 minutes, 4500 rpm and discard the supernatant. The pellet is resuspended in mBG11 medium supplemented with 50 mM TES pH 7.3, 20 mM $NaHCO_3$, and appropriate metal ions for induction without antibiotics. The sample will be adjusted to an $OD_{750}$ of about 0.7 (+/−0.1) for 4 replicates. 2 mL are filled in 20 mL GC vials equipped with a magnetic stir bar (12 mm) in which the lid is not completely tightened 5 mL pure carbon dioxide is injected for 1-3 days with the 30 mL syringe through the septum, and then the lid tightly closed (gas tight). The tightly closed GC vials are placed into the headspace auto sampler rack which is temperature controlled at a given temperature for example 37° C. and are analyzed at the same day. After the GC measurements the final $OD_{750}$ is determined for the calculation of the ethanol production rate per average $OD_{750}$. The average cell density for each sample is determined by calculating the arithmetic mean of the optical density at the starting point and the optical density at the end point of the process.

If necessary, reference samples for the calibration of the gas chromatograph can be prepared as 2 millilitre aliquots with 0.005, 0.01, 0.02, 0.05, 0.1, 0.2, 0.5, 1, 2, 5 and 10 mg/mL ethanol in 35 psu sodium chloride. Reference samples are placed into the same 20 mL sample containers with self-sealing silicon septum caps for headspace autosampling. For each reference sample at least six measurements are applied. After the measurements, the resulting peak areas of the reference samples are used for generating two calibration curves, the first in the concentration range from 0.005 to 0.5 mg/mL ethanol and the second one for the concentration range from 0.5 to 10 mg/mL ethanol. The calibration curves have to fulfill linearity.

The sample incubation temperature for the GC online measurements in the autosampler is adjusted to a given temperature for example 37° C. The illumination is set at 90 µE to 150 µE, preferably 120 µE. The magnetic stirrer is configured for interval mixing of the samples, with cycles of 2 minutes mixing at 400 rpm, followed by 90 minutes without mixing. An automated process follows, wherein after given periods aliquots of 500 µL of the headspace of the samples are automatically drawn with the gas-tight headspace syringe and injected via the injection port into the gas chromatograph for analysis. Before each headspace autosampling, the mixing is changed for 10 min to continuous mixing with 750 rpm at 37° C. incubation temperature. The syringe temperature is set at 70° C. The fill speed is 250 µL per second, following an initial lag time of 1 second after the septum of the samples has been pierced by the syringe needle. The injection of the aliquot into the gas chromatograph happens with an injection speed of 500 µL per second. Afterwards, the syringe flushes for 3 minutes with air to prevent sample carryover between two injections. The gas chromatograph runtime is 4 minutes and 30 seconds. The injection temperature on the gas chromatograph is 230° C. The column temperature is 60° C. Detection is accomplished with the flame ionization detector at 250° C. process temperature. The makeup gas is nitrogen at 30 mL per minute, the fuel gas is hydrogen at 35 mL per minute and the oxidizer gas is artificial air at 400 mL per minute.

After the final GC online vial measurement, the final optical density at 750 nm of the samples is measured and an average cell density for each sample is determined by calculating the arithmetic mean of the optical density at the starting point and the optical density at the end point of the process divided by two. Afterwards, the average ethanol production rate per cell density is calculated.

In a typical GC online vial experiment for the quantitative determination of acetaldehyde and/or ethanol content in growth media by headspace gas chromatography (GC), the ethanol production of the respective cyanobacterial culture has to be induced 1-3 days prior to the GC measurement to trigger the expression of the pdc and adh production genes. For instance, to repress the PnirA promoter (e.g. in TK225, TK293) hybrids were grown in mBG11 (artificial seawater) depleted of $NO_3^-$, with 2 mM Urea and 2 mM $NH_4Cl$ as alternative nitrogen source. To induce the nirA promoter, cells were transferred prior to the GC online vial measurement into mBG11 (artificial seawater salts) with nitrate. For GC measurements cells were harvested from liquid cultures by centrifugation and then resuspended in the appropriate fresh marine medium ensuring that the induction conditions were maintained. The medium was further supplemented with 50 mM TES, pH 7.3 and 20 mM $NaHCO_3$. The sample was adjusted to an $OD_{750nm}$ of 0.8 and 2 mL samples were then aliquoted per 20 mL GC vial loaded with 4-5 mL pure $CO_2$ depending on the planned duration of the culture experiment. The tightly closed GC vials were placed onto an illuminated (120 µE $m^{-2}s^{-1}$) headspace auto sampler and were analyzed on the same day on a Shimadzu GC-2010 gas chromatograph equipped with a medium-bore capillary column (FS-CS-624, length 30 m; I.D. 0.32 mm; film 1.8 µm) and a flame ionization detector.

The culture was stirred once in an hour under constant light (approximately 120 µE) in GC vials (temperature 37° C.) on the GC sampling tray. Acetaldehyde and ethanol content were measured online at four different time points during 40-48 hours. Measurements can be extended up to 72 hours.

After completion of the GC online vial measurements, the final $OD_{750nm}$ was determined to normalize the ethanol production rate according to the average $OD_{750nm}$ of the bacterial sample. The average $OD_{750nm}$ was calculated as the arithmetic mean of the OD750nm at the time of sample preparation and the $OD_{750nm}$ after completion of the GC measurement.

The results of the ethanol quantitation are exemplarily shown in FIG. 47 and e.g. tables 4, 5, and 9. ABICyano1 with TK293 produced a high amount of ethanol (~0.02% (v/v) OD*d), which is about 4 fold higher than with plasmid TK225.

Example 13: Activity Assay for Pyruvate Decarboxylase Enzyme

The Pdc enzyme activity assay is a photometric kinetic reaction that can be monitored at 340 nm using a spectrophotometer. Pyruvate is enzymatically converted to acetaldehyde by pyruvate decarboxylase, which is reduced to ethanol by ethanol dehydrogenase under NADH oxidation. The determined Pdc enzyme activity is related to the protein content.

Spin down 5-15 mL fresh culture material in a 15 mL tube (5,000 g, 10 min, 4° C). Adapt culture volume to optical density: OD750<1:20 ml, OD750 1-2:15 ml, OD750 2-5:5 ml, OD750>5:3 mL culture as approximation. Resuspend the pellet in 0.9 mL pre-chilled (4° C.) Purification Buffer (50 mM MIES, 100 μM EDTA, 1 mM TPP, 2 mM DTT, 0.025 mg/mL lysozyme). Take 0.9 mL supernatant and add 750 μL pre-chilled glass beads in a 2.0 mL safe-lock Eppendorf tube. Cell disruption is done with the mixer mill (Retsch) for 15 min at 30 Hz. The resulting suspension is incubated at 35° C. for 30 min in a thermomixer. Afterwards the samples are centrifuged (10,000 g, 10 min) and the supernatant is then used for the analysis.

The PDC enzyme measurement can be done in a photometer or in a plate reader. For the measurement in a cuvette mix 500 μL supernatant sample. 2 μL (15 mg/mL) ADH and 463 μL of Reaction Buffer (1) (43.2 mM MPS buffer, 0.43 mM NADH, 10.8 mM CaCl2) in the cuvette. For the measurement in a plate reader mix 20 μL supernatant sample and 173 μL of Reaction Buffer (2) (23.1 mM MES buffer, 0.231 mM NADH, 5.8 mM CaCl2, 0.031 mg/mL ADH) in the plate. Incubate the sample in the spectrophotometer resp. plate reader until a stable baseline is observed (~200 s).

Start the reaction by addition of 35 μL 300 mM pyruvate into the cuvette resp. 7 μL in each well of the 96 deep-well plate and record adsorption at a wavelength of 340 nm for 600 s.

Oxidation of NADH is observed as a decrease of absorbance at 340 nm. Typical values from the bench top PBR are 100-300 nmol·min-1·mg-1-protein.

For calculating the specific Pdc enzyme activity in the cell extract, the protein amount in the supernatant based on the method Lowry et. al. is determined. For the sample preparation the DOC/TCA precipitation method (DOC=Na deoxycholate, detergent; TCA=trichloroacetic acid) is used.

Example 14: Non-Naturally Occurring Ethanologenic ABICyano1 Organisms

Various embodiments of non-naturally occurring ethanologenic ABICyano1 organisms of the invention disclosed herein are exemplified through the depiction of ethanol production, PDC activity and other characteristics of the non-naturally occurring organisms as exemplifed in the following figures.

FIG. 28 depicts the ethanol production normalized to the growth ($OD_{750nm}$) determined by the CG vial method for ABICyano1 strains transformed with the plasmids #1606, plasmid #1629 and plasmid #1636 for a period of time of at least 20 days.

FIG. 29 depicts the specific activity of PDC determined by the CG vial method for ABICyano1 strains transformed with the plasmids #1606, plasmid #1629 and plasmid #1636 for a period of time of about 20 days.

FIG. 30 depicts the specific activity of ADH determined by the CG vial method for ABICyano1 strains transformed with the plasmids #1606, plasmid #1629 and plasmid #1636 for a period of time of about 20 days.

FIG. 31 depicts the ethanol production normalized to the growth ($OD_{750nm}$) determined by the CG vial method for ABICyano1 strains transformed with the plasmids plasmids #1606, plasmid #1631 and plasmid #1632 for a period of time of at least 20 days.

FIG. 32 depicts the specific activity of PDC determined by the CG vial method for ABICyano1 strains transformed with the plasmids #1606, plasmid #1631 and plasmid #1632 for a period of time of at least 20 days.

FIG. 33 depicts the specific activity of ADH determined by the CG vial method for ABICyano1 strains transformed with the plasmids #1606, plasmid #1631 and plasmid #1632 for a period of time of at least 20 days.

FIG. 34 depicts the production of ethanol and acetaldehyde determined by the GC vial method from *Cyanobacterium* sp. ABICyano1 strains containing either one of ethanologenic plasmids TK293 and TK225.

FIGS. 35A to 35D depict the ethanol production rate, acetaldehyde accumulation and ADH and PDC activities of about a 15 day cultivation of *Cyanobacterium* sp. ABICyano1 containing the ethanologenic plasmid TK225. Panel A depicts ethanol production (percent ethanol per volume per day) panel B depicts acetaldehyde (percent w/v), panel C depicts PDC enzyme activity over time, and panel D depicts ADH enzyme activity over time.

FIGS. 36A to 36C depict ethanol production rate, cell growth and maximum ethanol production rate for 7 days from a 14 day cultivation of *Cyanobacterium* sp. ABICyano1 containing the ethanologenic plasmid TK293.

FIG. 37 depicts the ethanol production rates and the acetaldehyde accumulation determined by the GC vial method for *Cyanobacterium* sp. ABICyano1 strains variously containing different ethanologenic plasmids TK293, #1495, #1578 and #1581 that were cultivated for 40 hours.

FIG. 38 depicts and compares (in the left panel) the PDC enzyme activity and (in the right panel) the ADH enzyme activity between ABICyano1 host cells each containing one of the plasmids TK293, #1495, #1578, and #1581.

In an embodiment, transformed ABICyano1 cells containing ethanologenic cassettes are grown under inducing conditions in mBG11 medium, and may be tested for ethanol production. ABICyano1 containing the plasmids TK293 and TK225 produced 0.086% (v/v) and 0.019% (v/v) ethanol, respectively, over a 50 h period in an online GC vial system (FIG. 34). Cultivation of ethanologenic ABICyano1 cells was performed in 0.5 L round PBR glass vessels containing marine BG11 culture medium. pH was controlled via $CO_2$ flux. Cell growth and ethanol production are shown in FIG. 35 and FIG. 36 for ABICyano1 containing TK225 and TK293, respectively.

ABICyano1 organisms variously containing plasmids #1606, #1629 and #1636 with a pdc gene under the transcriptional control of either the native nirA promoter, or modified variants thereof, were cultured in 0.5 L photobioreactors. These enhanced ABICyano1 variously contained plasmids #1606, #1629 and #1636. FIG. 28 shows the ethanol production normalized to growth ($OD_{750nm}$) as determined by the CG vial method for ABICyano1 transformed with plasmids #1606 (a pdc gene under the control of the native $P_{nirA}$), plasmid #1629 (a pdc gene under the control of a variant of $P_{nirA}$ with changes in the RBS) and plasmid #1636 (a pdc gene under the control of a modified variant of $P_{nirA}$ with changes in the operator sequence and the TATA box). Ethanol production was measured over a period of at least 20 days after induction. Induction of $P_{nirA}$ was realized by transition of the pre-culture to mBG11 medium containing nitrate for induction at the beginning of the cultivation experiment. FIG. 28 depicts that the normalized ethanol production is higher for ABICyano1 containing the plasmids with modified promoters. FIGS. 29 and 30 depict the specific activity of PDC enzyme and ADH enzyme during the course of cultivation. The inducible, modified nirA promoter variants PnirA*2 (#1629) and PnirA*3 (#1636) result in higher activity of PDC enzyme compared to the native promoter (#1606).

A petJ promoter endogenous to ABICyano1 was identified and further characterized. Expression of $P_{petJ}$ is tightly repressed under high copper (1-3 µM) conditions and induced under copper depletion as depicted in FIG. 39A. An ABICyano1 TK441 strain having the endogenous $P_{petJ}$ upstream of an ethanologenic gene cassette produced the same amount of ethanol (percent v/v) under copper depletion conditions as compared to an ABICyano1 TK293 strain grown in marine BG11 (FIGS. 39A and 39B).

FIG. 31 depicts ethanol production, as determined by the GC vial method, normalized to growth, as represented by absorbance at $OD_{750nm}$, for ABICyano1 transformed with plasmids #1606 (a pdc gene under the control of the native $P_{nirA}$), plasmid #1631 (a pdc gene under the control of a modified $P_{corT}$ with modifications in the TATA box) and plasmid #1632 (a pdc gene under the control of a modified $P_{corT}$ with modifications in the TATA box and the RBS). Ethanol production was measured for a period of time of at least 20 days while the cells were cultured in 0.5 L photobioreactors. The value for ethanol production of ABICyano1 transformed with plasmid #1606 is close to the value for ethanol production of ABICyano1 transformed with plasmid #1632. The ethanol production of the ABICyano1 transformed with plasmid #1631 exhibits a lower ethanol production rate than ABICyano1 transformed with plasmids #1606 and #1632, especially in the time period starting from about the tenth day of cultivation.

FIGS. 32 and 33 depict the specific activity of PDC enzyme and ADH enzyme during the course of cultivation. ABICyano1 transformed with plasmids #1632 and #1606 demonstrated higher activity of PDC enzyme than ABICyano1 transformed with plasmid #1631.

FIGS. 40, 41 and 42 depict the ethanol production rates of the ABICyano1 transformed with plasmid #1635, or plasmid #1639, or plasmid #1640, respectively. ABICyano1 strains containing plasmid #1635, or plasmid #1639, or plasmid #1640 all include the native $P_{smtA}$ from Synechococcus PCC 7002 as well as modified versions of $P_{smtA}$. FIGS. 40, 41 and 42 demonstrate that the promoters are repressed in the absence of $Zn^{2+}$ and can be induced upon addition of $Zn^{2+}$.

Modified vectors such as TK293, and #1536 each containing an ethanologenic cassette and an antibiotic resistance gene under the transcriptional control of an ABICyano1 and/or an endogenous promoter of Synechococcus PCC 7002, respectively, are transformed into Synechococcus PCC 7002 using electroporation, conjugation or natural uptake. The transformants are selected for on an agar plate using the appropriate antibiotic. The putative transformants are then confirmed by PCR analysis. Positive cells are streaked and scaled up to grow as a culture. Ethanol production is measured. By use of this method, ethanol would be produced using a p6.8 derived vector containing an ethanologenic cassette using organisms other than those of the genus Cyanobacterium and/or ABICyano1.

ABICyano1 strains containing the following constructs were tested for ethanol production, cell growth, ADH activity, and PDH activity:

TK293 [p171-6.8_PnirA-zmPDC(opt1)-PrpsL-synADH(opt1)_ter]
1495 [p171-6.8_PnirA-zmPDC(opt3)-PrpsL-synADH(opt3)_ter]
1578 [p171-6.8_PnirA-zmPDC(opt3)_dsrA-Prbc*(optRBS)-synADH_ter]
1580 [p171-6.8_PnirA-zmPDC(opt1)_dsrA-PrpsL-synADH(opt1)_ter]
1581 [p171-6.8_PnirA-zmPDC(opt3)_dsrA-PrpsL-synADH(opt3)_ter]
1601 [p171-6.8_PnirA-zmPDC(opt1)_dsrA-Prbc*(optRBS)-synADH(opt3)_ter]
1606 [p171-6.8_PnirA-zmPDC(opt1)_dsrA-Prbc*(optRBS)-synADH(opt1)_ter]
TK411 [p171-6.8_PnirA-zmPDC(opt3)-PrpsL-synADH(opt1)_ter]
TK412 [p171-6.8_PnirA-zmPDC(opt1)-PrpsL-synADH(opt3)_ter]

As depicted in FIG. 43, different variations of the components of the ethanologenic gene cassette were created. In an embodiment, one of the resulting constructs #1578 resulted in an improved ethanol production rate compared to TK293. Construct #1578 included the zmpdc gene with a third version of codon-optimization, an additional introduced transcriptional terminator dsrA, and the native synadh gene whose expression is controlled by the artificial rbc*(optRBS) promoter which is an improved valiant of the rbcL promoter derived from Synechocystis PCC 6803.

FIG. 44 depicts cell growth, ethanol production and nornialized ethanol production of ABICyano1 with TK293 or #1578. FIG. 45 depicts PDC and ADH activity in ABICyano1 with TK293 or #1578. FIG. 46 depicts overlays of the curve progression in regard to cell growth, overlays of the curve progression in regard to ethanol production, overlays of the curve progression in regard to the ethanol production rate and a comparison of the PDC and ADH activity between ABICyano1 #1578 and ABICyano1 TK293. As depicted in FIGS. 44 to 46, both components in combination with the additional terminator in between both genes result in an increased PDC as well as ADH activity over time which consequently lead to a higher ethanol production rate and at the same time reduced growth rate. This observation indicates a higher carbon-partitioning (amount of carbon fixed into ethanol versus not fixed into ethanol) for strain ABICyano1 #1578 compared to ABICyano1 TK293 and demonstrates the high potential of optimizing the ethanologenic gene cassette in order to improve the ethanol productivity for ABICyano1 and other cyanobacteria.

As depicted in FIG. 38, ADH expression is controlled by promoter PrpsL. The expression level of the synADHopt3 cassette present in #1495 and #1581 is apparently less efficient compared to the expression level of the synADHopt1 present in ABICyano1 TK293 and ABICyano1 #1580. Not being limited by theory, this might be explained by the different codon-usage strategy applied for the synADHopt1 gene version as exemplified through testing constructs TK411 and TK412, comprising synADHopt1 and synADHopt3 respectively. TK411 exhibited a similar ADH activity as TK293 whereas TK411 revealed a relatively low ADH activity. This low ADH activity detected for TK412 was accompanied with an elevated acetaldehyde accumulation as found previously for #1495 and #1581, both with synADHopt3. This clearly demonstrates the better performance of synADHopt1 in relation to synADHopt3.

Furthermore, analyses of ADH activity from ABICyano1 strains #1601 and #1606 confirmed the different efficiency when using synADHopt3 vs. synADHopt1. Strain #1601 [p171-6.8_PnirA-zmPDC(opt1)_dsrA-Prbc*(optRBS)-synADH(opt3)_ter] exhibited a relatively low ADH activity and consequently a higher acetaldehyde accumulation in GC vial assay whereas the experiments with strain #1606 [p171-6.8_PnirA-zmPDC(opt1)_dsrA-Prbc*(optRBS)-synADH(opt1)_ter] indicated a higher ADH activity in relation to #1601 and thus a lower acetaldehyde accumulation. Nevertheless, the highest activity found for the different gene variants of synADH was suiprisingly accomplished by the native synADH (ABICyano1 #1578) without any codon-optimization for use in ABICyano1. Codon optimization is usually needed for efficient protein expression in ABICyano1 because it has a strong AT bias in endogenous codon-usage.

As depicted in FIG. 47, although strains ABICyano1 #1495 and ABICyano1 #1581 differ in the dsrA terminator downstream from the pdc gene, the PDC expression in ABICyano1 #1581 was found to be substantially increased. This is an indication that introduction of an efficient transcript termination signal apparently results in a higher and/or more stable mRNA levels and consequently in an increased PDC protein expression. In ABICyano1 #1578 growth is thereby reduced but the ethanol production is significantly increased demonstrating that the improved PDC expression results in an improved relative production of ethanol in comparison to biomass.

The data depicted in table 5 demonstrate the improved (when compared to TK293) production rate of ethanol as well as the elevated PDC and ADH activities for ABICyano1 that has been genetically enhanced with construct #1578. The cultivation of the corresponding cell lines was performed in 0.5 L Crison PBR round bottles illuminated from two sides with 450 µE m$^{-2}$s$^{-1}$ (900 µE m$^{-2}$s$^{-1}$ total) for 36 days including two dilution steps. During this long-term cultivation the OD, the chlorophyll content, and the ethanol amount were measured.

As depicted in FIG. 47, the introduction of alterations in the ethanologenic gene cassette resulted in improved expression and improved activity of PDC and synADH. The alterations enhanced ethanol productivity in ABICyano1 by about 20-25%. While not being limited by theory, FIG. 48 depicts the higher ethanol production rate and lower growth for ABICyano1 #1578 as compared to TK293 and shows that PDC may regulate the partitioning of carbon fixed by photosynthesis into biomass and ethanol. ABICyano1 #1578 thus increases total carbon fixation and ethanol production by about 10% compared to ABICyano1 TK293.

FIG. 49 depicts ethanol production in several ABICyano1 strains including copper-inducible promoters controlling the pdc expression. As depicted in FIG. 49, strain TK483 which contains $P_{orf0221}$, strain TK487 and strain #1772 which both contain $P_{orf0316}$ produce more ethanol over the same amount of time than does strain TK293 that contains a $P_{nirA}$ promoter controlling the pdc expression. All of the strains depicted in FIG. 49 were cultivated in a vPBR system at 230 µE*m$^{-2}$*s$^{-1}$ in a 12 h/12 day/night cycle.

As depicted in table 6 and the following figures, promoters controlling the open reading frames found to be regulated by addition of the respective metal ions (and verified by qPCR), were chosen to be used in constructs for ethanol production in ABICyano1. A 300-500 bp fragment upstream of each start codon was selected and cloned into plasmid #1646, replacing the nirA promoter, in order to drive pdc transcription. ABICyano1 transformants were tested for ethanol productivity under repressed and induced conditions in GC vial experiments. FIG. 50 depicts the ethanol production of ABICyano1 TK293 (p171-6.8::PnirA-PDC(opt1)-PrpsL-synADH (opt1)_ter) compared to ABICyano1 TK483 (p171-6.8:: Porf0221-zmPDC_(opt1)dsrA-Prbc*(optRBS)-ADH111 (opt)_ter) in the presence and absence of 3 µM Cu$^{2+}$. In the absence of copper, ethanol production rates are very low, indicating the tightness of Porf0221. By contrast, ethanol production of ABICyano1 TK483 in the presence of 3 µM Cu$^{2+}$ is even higher compared to ABICyano1 TK293.

The ethanol productivity (EtOH(v/v)/OD/day) of each construct is shown in table 6 under repressed (without the respective metal ion) and induced conditions (10 µM Ni$^{2+}$, 15 µM Zn$^{2+}$, 3 µM Cu$^{2+}$ or 5 µM Co$^{2+}$). Tightness and strength of each promoter were also rated with a +/- scale, (see legend below Table 3). In an embodiment, ethanol production rates of all tested promoters can be divided into different categories as follows: 1) ethanol productivity was very low, even under inducing conditions (e.g. TK500), 2) ethanol productivity was quite high, however, the promoter was not repressible (e.g. TK501) and 3) ethanol productivity was quite high and promoter repressible/inducible (e.g. TK483). In some cases two constructs were generated for one promoter (e.g. TK493/TK527 for Porf0128), as two putative start codons for the respective gene could be deduced.

Ethanol producing ABICyano1 host cell strains carrying the Zn$^{2+}$ inducible constructs TK480 and TK490 as well as the Cu$^{2+}$ inducible TK483, TK487 and TK504 were analyzed for tightness of promoter control of the expression of ethanologenic genes. All five constructs are very tightly repressed under appropriate conditions (lack of inducer metal) and led to high ethanol production rates after metal ion addition. TK480 uses a mntC promoter, which was shown in *Synechocystis* PCC 6803 to be regulated by manganese (Ogawa et al., 2002). Hence repression by addition of Mn$^{2+}$ was tested, see table 6, and addition of 40-50 µM Mn$^{2+}$ led to a repression.

Thus, orf0221 encodes for a putative multi-copper oxidase (copper-resistance protein), while orf0223 and orf0316 are hypothetical genes with unknown function. All three genes/proteins are believed to have not been previously described in the literature, induction by copper was not known. Based on homology to other copper regulated genes, none of the three endogenous promoters from ABICyano1 would have been chosen to control pdc expression. However, the three promoters respond strongly to copper and were shown to tightly control ethanol production in ABICyano1. Because the response to copper declines within about 5 days, additional copper needs to be supplemented during long term ethanol production experiments. In an embodiment, the copper repressible promoter of petJ (orf3461) is useful. No ethanol production was observed with the promoter of orf3232, encoding for a heavy metal ATPase. As the copper response stayed at a constant level up to about day 5, the promoter of orf3232 could be useful for longer productivity. Not being hound by theory, one explanation is that both cloned translational start codons are selected in the upstream region of about 500 bp and might not use the entire functional promoter.

The Zn$^{2+}$ responding promoter of the smtA like orf3126 improved amounts of produced ethanol. However, basal (repressed) production rates were too high. Additional genetic optimization could enhance the genetic stability. By contrast, the Zn$^{2+}$ responding promoter of the manganese transporter operon (mntABC) is repressed by addition of 40 µM Mn$^{2+}$.

At least three Cu$^{2+}$ responding (Porf0221, Porf0223 and Porf0316) and two Zn$^{2+}$ responding promoters (Porf1071 and Porf3126) are useful as promoters to drive pdc expression in ABICyano1 ethanologenic strains.

FIGS. 59 to 66 depict the ethanol production of various different ABICyano1 strains carrying different metal-inducible promoters upstream of the pdc gene determined by the GC online vial method.

FIG. 59 depicts the ethanol production of *Cyanobacterium* sp. ABICyano1 containing the plasmid TK480 wherein a codon improved variant of a gene coding for the native PDC enzyme is under the transcriptional control of the promoter mntC (orf1071) from ABICyano1, whereas the adh with the nucleotide sequence shown in FIG. 52 (nucleotides 2390 to 3406 of SEQ ID NO: 60) is under the control of a variant of the native rbc promoter from ABICyano1 with an improved ribosomal binding site (RBS). Furthermore, the ethanol production of *Cyanobacterium* sp. ABICyano1 containing the plasmid #1770 is depicted in FIG. 59, which is comparable to the ethanol production of *Cyanobacterium* sp. ABICyano1 with the plasmid TK480. This plasmid #1770 only differs from plasmid TK480 by replacing the Adh enzyme of FIG. 52 (nucleotides 2390 to 3406 of SEQ ID NO: 60) with the Synechocystis Adh enzyme. It can clearly be seen that upon addition of 10 µM $Zn^{2+}$ the ethanol production increased compared to the uninduced state with $Zn^{2+}$ and 15 µM $Mn^{2+}$ (repression by the absence of $Zn^{2+}$ and presence of $Mn^{2+}$) for both strains transformed with the plasmids #1770 and TK480, respectively. The ethanol production of *Cyanobacterium* sp. ABICyano1 including the plasmid TK488 after addition of 15 µM $Zn^{2+}$ is shown in FIG. 60 in comparison to the uninduced state without $Zn^{2+}$. Addition of $Zn^{2+}$ leads to a nearly 4-fold increase in ethanol production.

The ethanol production of *Cyanobacterium* sp. ABICyano1 containing the plasmid TK489 is depicted in FIG. 61. This graph shows a continuously rising ethanol production with increasing cultivation time in the induced state upon addition of 15 µM $Zn^{2+}$. However under uninduced conditions a high ethanol production can also be observed, which shows that this promoter is not very tight.

FIG. 62 depicts a graph evidencing the ethanol production in ABICyano1 transformed with the plasmid TK490 including a codon improved variant of pdc gene under the transcriptional control of the promoter controlling the open reading frame (ORF) 3126 versus the ethanol production of the same strain transformed with the plasmid #1773. This plasmid differs from TK490 only in the Adh enzyme which is Synechocystis Adh for #1773 versus the adh with the sequence of FIG. 52 (nucleotides 2390 to 3406 of SEQ ID NO: 60) in TK490. Both ABICyano1 strains have a comparable ethanol production up to 40 hours of cultivation, but the ethanol production appears to be higher for #1773 after 40 hours compared to TK490. A clear increase in ethanol production can be observed upon induction by 15 µM $Zn^{2+}$ for both strains transformed with #1773 and TK490. A clear rise in ethanol production can also be seen upon induction with $Cu^{2+}$ in *Cyanobacterium* p. ABICyano1 transformed with the plasmid TK487 and the plasmid #1772 (see FIG. 63). TK487 includes a codon improved variant of the *Zymomonas mobilis* gene coding for PDC under the transcriptional control of the promoter controlling the ORF0316 and codon improved variant of the gene coding for ADH with the nucleotide sequence shown in FIG. 52 (nucleotides 2390 to 3406 of SEQ ID NO: 60) under the transcriptional control of Prbc with an improved RBS. The plasmid #1772 contains a gene coding for Synechocystis ADH instead of the ADH with the sequence of FIG. 52 (nucleotides 2390 to 3406 of SEQ ID NO: 60). Induction with copper leads to an increase in ethanol production for both ABICyano1 strains. The ethanol production increases in comparison to the uninduced state upon addition of 0.3 µM $Cu^{2+}$ and further increases, when both strains are induced with 6 µM $Cu^{2+}$. A clear rise in ethanol production can be observed by copper induction in ABICyano1 with strains containing the plasmids TK483 and #1771 upon addition of 0.3 µM and 6 µM $Cu^{2+}$ (see FIG. 64).

Table 8 depicts ethanol production data of ABICyano1 strains containing plasmids with genes coding for PDC under the control of endogenous inducible promoters.

As depicted in FIG. 67, copper-inducible strains such as #1771 ($P_{orf0221}$), #1772 ($P_{orf0316}$) and #1774 ($P_{orf0223}$) as well as a zinc-inducible strain #1770 ($P_{mntC}$) exhibit a higher ethanol productivity than a nitrate inducible strain TK293 that uses a PnirA promoter. Induction protocols use initial $Cu^{2+}$ addition and also further $Cu^{2+}$ additions. As depicted in FIG. 68, the PDC activity of strains #1770, #1771, #1772 and #1774 were greater than TK293. The strains depicted in FIGS. 67 and 68 cultivated in a vertical photobioreactor (vPBR) at 200 µE*$m^{-2}$*$s^{-1}$ in a 12 h/12 day/night cycle.

Initial induction with 1.6 µM $Cu^{2+}$ (which is about five times the $Cu^{2+}$ concentration of BG11) in all four treatments of TK487 for ethanol production is depicted in FIG. 69 and for cell growth of TK487, in FIG. 70. TK487 is identical to #1772 ($P_{orf0316}$), except for a different adh gene. PDC activity in TK487 is depicted in FIG. 71. Ethanol per cell density of induced TK487 is depicted in FIG. 72. Weekly and bi-weekly (day 7 and 21) copper addition results in the highest tested ethanol production and lowest biomass accumulation.

Table 9 depicts the ethanol production data for various ABICyano1 strains including strains and plasmids, #1578/ #1646, #1658/#1684, #1658 FIG. 118 (SEQ ID NO: 72), #1663 FIG. 119 (SEQ ID NO: 73), #1697/#1665, #1697 FIG. 120 (SEQ ID NO: 74), TK480/#1770, TK483/#1771, TK487/ #1772, TK490/#1773, and TK504/#1774.

FIG. 28 depicts the ethanol production normalized to the growth ($OD_{750nm}$) determined by GC single measurements for ABICyano1 strains transformed with the plasmids #1606 (pdc gene under the control of the native PnirA), plasmid #1629 (pdc gene under the control of a modified variant of PnirA with changes in the RBS) and plasmid #1636 (pdc gene under the control of a modified variant of PnirA with changes in the operator sequence and the TATA box) for a period of time of at least 20 days after induction was realized by transition of the pre-culture to usual mBG11 medium (containing nitrate for induction) at the beginning of the cultivation experiment. The graph depicts that the normalized ethanol production is higher for the strains including the plasmids with the modified promoters. FIGS. 29 and 30 depict the specific activity of PDC and ADH during the course of the above mentioned cultivation. As depicted in FIGS. 29 and 30 the inducible modified nirA promoter variants PnirA*2 (#1629) and PnirA*3 (#1636) result in a higher activity of PDC enzyme compared to the native promoter (#1606).

FIG. 31 depicts the ethanol production normalized to the growth ($OD_{750nm}$) determined by the GC single measurement method for ABICyano1 strains transformed with the plasmids #1606 (pdc gene under the control of the native PnirA), plasmid #1631 (pdc gene under the control of a modified PcorT with modifications in the TATA box) and plasmid #1632 (pdc gene under the control of a modified PcorT with modifications in the TATA box and the RBS) for a period of time of at least 20 days cultured in 0.5 L photobioreactors. The ethanol production of the strain transformed with the plasmid containing the native PnirA with pdc gene is comparable to the ethanol production of the strain containing the plasmid with the pdc gene controlled by the modified corT promoter variants PcorT*3 (#1632) with modifications in the TATA box and RBS, whereas the ethanol production of the strain containing the plasmid with PcorT with modifications only in the TATA box PcorT*2 (#1631) exhibits a lower ethanol production rate, especially in the time period starting from the tenth day of cultivation on.

FIGS. 32 and 33 depict the specific activity of PDC enzyme and Adh enzyme during the course of the above mentioned cultivation. The strains with the native PnirA as well as the PcorT with modifications in the TATA box and the RBS show higher reactivity of PDC enzyme than the other strain.

FIGS. 40 to 42 depict the ethanol production rates of the ABICyano1 strains transformed with the plasmids #1635, #1639 and #1640 including the native PsmtA promoter from *Synechococcus* PCC 7002 as well as modified versions of PsmtA. It can clearly be seen that all promoters are repressed in the absence of $Zn^{2+}$ and can be induced upon addition of $Zn^{2+}$.

FIG. 81 depicts the activity of PDC enzyme in the uninduced state and after 72 hours of induction for ABICyano1 strains transformed with the plasmids #1578, #1701, #1658, #1697 and #1663, including an unmodified endogenous nirA promoter (plasmid #1578), and four different modified nirA promoter variants PnirA*1 (plasmid #1701), PnirA*2 (plasmid #1658), PnirA*3 (plasmid #1697) and PnirA*4 (plasmid #1663). Cultivation of those ethanologenic hybrids was performed in GC vials for 72 hours. The Pdc activity after induction is indicated by the blue bars whereas the much lower activity of Pdc enzyme in the repressed state is given by the red bars. The induction factors for these plasmids #1578, #1701, #1658, #1697 and #1663 are 12, 10, 14, 8, and 7 times the Pdc activity in the induced state vs. the repressed state. This figure depicts that specific nucleotide changes introduced into the ribosomal binding site and/or the promoter region of the nirA promoter in the respective variants PnirA*1, PnirA*2, PnirA*3 and PnirA*4 increased the expression level of the PDC in the induced state, but had relatively little impact on the tightness of the modified promoter in the repressed state.

FIGS. 82 and 83 depict the activity of PDC and their respective $OD_{750nm}$-normalized ethanol production (% EtOH per $OD_{750nm}$) during the course of a 29 day cultivation grown at 125 $\mu E*m^{-2}*s^{-1}$ in a 12 h/12 day/night cycle for the above mentioned strains of FIG. 81 except for #1701 which was omitted. The Pdc activity of #1697 (PnirA*3) and #1663 (PnirA*4) is higher and more stable over time than that of #1578 (PnirA) and #1658 (PnirA*2). Therefore the ratio of carbon distribution into ethanol and biomass (EtOH/OD ratio) is thereby higher and appears to be more stable over time for the transformants. FIGS. 84 and 85 depict the $OD_{750nm}$, and the ethanol production in % (v/v) of this about 30 day cultivation grown at 125 $\mu E*m^{-2}*s^{-1}$ in a 12 h/12 day/night cycle. ABICyano1 strains transformed with plasmids #1578 (PnirA) and #1658 (PnirA*2), show a similar ethanol production rate over about 29 days.

FIG. 86 depicts ADH and PDC activity in TK293, 1578 and 1792. FIG. 87 depicts total ethanol production in TK293, 1578 and 1792. FIG. 88 depicts ethanol production per $OD_{750}$ in TK293, 1578 and 1792. TK293 is p171-6.8::PnirA-zmPDC(opt1)-PrpsL-synADH(opt1)¯ter; #1578 is p171-6.8::PnirA-zmPDC(opt3)dsrA-Prbc*(optRBS)-synADH_oop; #1749 is p171-6.8::PnirA-zmPDC(opt3)dsrA-PrpsL*4-synADH_oop; and #1751 is p171-6.8::PnirA-zmPDC(opt3)dsrA-PcpcB-synADH_oop.

ABICyano1 containing plasmid #1792 results in improved synADH expression and shows better and more stable ethanol production under standard conditions. As depicted in FIGS. 89-91, increased ADH activity prevents PDC inactivation. FIG. 89 depicts acetaldehyde accumulation of TK293, #1578, #1749, and #1792. FIG. 90 depicts ADH activity in TK293, #1578, #1749, and #1792. Conversely, acetaldehyde exposure during cultivation reduces PDC activity. Thus, there is an inverse relationship between ADH activity and acetaldehyde accumulation for different synADH expressing strains in GC vial assay. FIG. 91 depicts specific PDC activity in varying amounts of acetaldehyde. Acetaldehyde is completely consumed within 1-2 hours.

Higher ADH activity helps to prevent PDC inactivation. A decrease in PDC activity was detected for several strains with very low ADH activity (in spite of identical PDC cassettes). FIG. 92 depicts ADH activity and FIG. 93 depicts PDC activity with or without the addition of acetaldehye (3 mM for 5 hours) for strains TK293, #1578, #1749, and #1751 each having different ADH activity levels.

ABICyano1 ethanologenic pdc/adh cassettes useful for extended production of ethanol in a ABICyano1 host cell include #1578 (p171-6.8::PnirA-zmPDC(opt3)_dsrA-Prbc*(optRBS)-synADH_oop); #1728 (p171-6.8::PnirA-zmPDC(opt3)_dsrA-PcpcB-ADH111(opt)_ter); and #1749 (p171-6.8::PnirA-zmPDC(opt3)_dsrA-PrpsL*4-synADH_oop).

The expression of heterologous adh genes from other cyanobacterial species that have been improved for codon usage patterns in ABICyano1 resulted in increased ADH activity. FIG. 94 depicts ADH activity of various expressed adh genes, some of which were codon improved for expression in ABICyano1. ADH242 is derived from *Arthrospira platensis* and ADH111 is derived from Lyngbya species. Constructs #1646 and #1754 had codon improved adh genes for ADH111 and ADH242, respectively. As depicted in FIG. 94, codon improvement for expression in ABICyano1 for the genes encoding for ADH111 and ADH242 resulted in an increase in ADH activity by about 30% to about 50%.

Increased ADH activity results in resistance to decreased ethanol production resulting from higher ethanol concentrations in the growth media. FIG. 95 depicts the effect of ethanol productivity of various ethanologenic ABICyano1 strains in growth media containing 1% ethanol. As depicted in FIG. 95, the difference between the production rate of ethanol in growth media containing no added ethanol and growth media containing 1% added ethanol is less when the expression of ADH is higher. FIG. 95 depicts the daily ethanol production rate in percent vol/vol per day over 10 days as measured from ABICyano1 strains illuminated with 250 $\mu E*m^{-2}*s^{-1}$ in 12 h/12 day/night cycles. As is depicted in FIG. 95, the stronger the ADH activity the less the impact of higher ethanol concentrations on ethanol production. As depicted in FIG. 95, ABICyano1 strain #1803 that expresses ADH from *Microcystis aeruginosa* exhibits less of a decrease in ethanol productivity (7% less) in a 1% ethanol growth solution when compared to the decrease in ethanol productivity of strain #1792 expressing ADH from Synechocystis PCC 6803 (39% less).

Ethanol production from ABICyano1 strains each containing a different adh gene operably linked to an endogenous ABICyano1 cpcB promoter and each strain containing a nirA promoter operably linked to pdc expression is depicted in FIG. 96. FIG. 96 also depicts the production of ethanol from strain TK293 (p171-6.8_PnirA-zmPDC(opt1)-PrpsL-synADH(opt1)_ter). Each strain depicted in FIG. 96 was cultivated in a vPBR system with exposure to light at 230 $\mu E*m^{-2}*s^{-1}$ in a 12 h/12 day/night cycle. As depicted in FIG. 96, the ethanol production of ABICyano1 strains 1790, 1791, 1792, 1793, 1794, and 1795 was greater than that of TK293 after about day 10 to about day 31 of growth.

ABICyano1 host cells transformed with ethanologenic vectors that contain more than one pdc gene demonstrated an increased duration of ethanol production. Induction of a second pdc gene increases PDC activity by about 2.5 times when compared to the induction of only a single pdc gene. Induction of a more than one pdc gene results in an increase in ethanol production and a decrease in cell growth. Thus ethanol production per $OD_{750}$ is higher for #1743 when both pdc genes are active. FIG. 97 depicts the PDC activity in strain #1743 with and without induction of 6 $\mu$M copper at about day 16 and the additional induction with 5 $\mu$M copper at about day 30. FIG. 98 depicts the total ethanol production of strain #1743 with and without the induction of copper. FIG. 99 depicts total ethanol per cell density measured at $OD_{750}$.

Dual pdc genes are introduced into an ABICyano1 host cell either on an integrative plasmid or on a replicative plasmid. Thus, the dual pdc genes, and other components of the ethanologenic cassette, can be integrated into the genome of ABICyano1 and/or exist on a plasmid within the ABICyano1 host cell. Strain #1743 is an ABICyano1 host cell containing a recombinant plasmid #1743 (pABIcyano1-PnirA-zmPDC(opt3)dsrA-Prbc*(optRBS)-synADHoop-Porf0221-zmPDC(opt1)dsrA) whose plasmid map is depicted in FIG. 156 and has a sequence that is depicted in SEQ ID NO: 106. Strain #1743 has two independently inducible pdc copies where one pdc gene is inducible by nitrate and the other pdc gene is inducible by copper. Strain #1743 was analyzed for PDC activity in comparison to the corresponding single pdc strains #1578 (pdc under control of promoter PnirA) and #1771 (pdc under control of promoter Porf0221). The analyses revealed independently inducible expression of both pdc genes from one construct. Without nitrate and copper addition, the pdc genes of strain #1743 were as tightly repressed as the single pdc strains #1578 and #1771. Long-term cultivation experiments using a copper inducible pdc construct resulted in increased PDC expression when compared to other inducible pdc constructs such as nitrate inducible pdc constructs.

The second pdc gene of strain #1743 was induced at day 16 of cultivation in a photobioreactor (at an $OD_{750}$ of about 5.5) by addition of $Cu^{2+}$. Strain #1744 having two pdc genes under control of PnirA and Porf3126 ($Zn^{2+}$) was also induced at day 16 of cultivation in a photobioreactor (at an $OD_{750}$ of about 5.5). The PDC activity in each strain increased to a value of about 5-6 µmol/mg*min in comparison to a value of about 2.5 µmol/mg*min for the control replicates without copper addition. Ethanol production increased about 10-15% at day 37 of cultivation. Additionally, the ethanol to $OD_{750}$ ratio increased.

The growth of strain #1743 containing two pdc genes, one pdc gene operably linked to a nirA promoter and a second pdc gene operably linked to a endogenous copper-inducible promoter Porf0221, is analyzed by measuring absorption at $OD_{750}$ of the growth media after induction of the copper-inducible promoter Porf0221. As depicted in FIG. 100, the addition of copper at day 19, 48 and at about day 108 caused a slight decrease in the rate of growth of ABICyano1 strain #1743 when compared to the control lacking copper in the growth media. As depicted in FIG. 101, the production of ethanol from strain #1743 was measured in the same growth media as depicted in the $OD_{750}$ measurements of FIG. 100. In an embodiment, as depicted in FIG. 101, the overall ethanol production increased when copper was added to the growth media at days 19 and 48. In another embodiment, PDC activity from strain #1743 was measured over about 115 days of growth. FIG. 102 depicts the PDC activity in ABICyano1 strain #1743 cells from growth media over the course of about 115 days. The growth media was diluted at about days 48, 78 and 106 of growth. In another embodiment, the total ethanol produced per cell density was measured. As depicted in FIG. 103, strain #1743 was grown for about 115 days and was diluted at about days 48, 78 and 106 of growth and amount of ethanol in percent volume per volume per $OD_{750}$ was measured. As depicted in FIG. 103 the induction of the pdc gene by introduction of copper into the growth media results in an increase in the amount of ethanol produced per $OD_{750}$ of ABICyano1 strain #1743 when compared to the ABICyano1 strain #1743 grown in media lacking copper.

Table 12 depicts a further list of plasmids for used for transformation of ABICyano1 with ethanologenic cassettes and also depicts the ethanol production in ABICyano1 host cells created thereby.

TABLE 12

| Strain | Genotype | % ethanol [v/v]/day | Relative % |
|---|---|---|---|
| TK293 n = 7 | pABICyano1-6.8::PnirA-zmPDC(opt1)-PrpsL171-synADH171(opt1)_ter | 0.0135 | 100 |
| #1578 n = 2 | pABICyano1-6.8::PnirA171-zmPDC171(opt3) dsrA-Prbc*(optRBS)-synADH_oop | 0.0169 | 125 |
| TK483 n = 3 | pABICyano1-6.8::Porf0221-zmPDC171(opt1)dsrA-Prbc*(optRBS)-ADH111(171opt)_ter | 0.0173 | 128 |
| TK487 n = 6 | pABICyano1-6.8::Porf0316-zmPDC171(opt1)dsrA-Prbc*(optRBS)-ADH111(171opt)_ter | 0.0177 | 131 |
| #1772* n = 3 | pABICyano1-6.8::Porf0316-zmPDC171(opt1)-dsrA-Prbc*(optRBS)-synADH_oop | 0.0168 | 124 |
| #1790 n = 4 | pABICyano1-6.8::PnirA171-zmPDC171(opt3) dsrA-PcpcB171-ADH242(171opt)_trbcS | 0.0175 | 130 |
| #1791 n = 4 | pABICyano1-6.8::PnirA171-zmPDC171(opt3) dsrA-PcpcB171-ADH111(171opt)_trbcS | 0.0192 | 142 |
| #1792 n = 4 | pABICyano1-6.8::PnirA171-zmPDC171(opt3) dsrA-PcpcB171-synADH_trbcS | 0.0174 | 129 |
| #1793 n = 4 | pABICyano1-6.8::PnirA171-zmPDC171(opt3) dsrA-PcpcB171-Adh916(171opt)_trbcS | 0.0198 | 147 |
| #1794 n = 2 | pABICyano1-6.8::PnirA171-zmPDC171(opt1) dsrA-PcpcB171-ADH1520(171opt)_trbcS | 0.0194 | 144 |
| #1795 n = 4 | pABICyano1-6.8::PnirA171-zmPDC171(opt1) dsrA-PcpcB171-ADH553.2(171opt)_trbcS | 0.0176 | 130 |

Articles, patents and other published literature referred to herein is incorporated by reference. Although the present disclosure has been described in considerable detail with reference to certain embodiments thereof, other embodiments are possible. Therefore, the spirit and scope of the appended claims should not be limited to the description of the embodiments contained herein.

SEQUENCE LISTING (161 sequences)

SEQ ID NO: 1 - DNA, 6828 bp, Cyanobacterium sp. ABICyano1
aatatttttcgtcagatacgcaaaccttacaaacataattaacaactgaaactattgatatgtctaggttttagctctatcacaggttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttg

SEQ ID NO: 2 - DNA, 35386 bp, Cyanobacterium sp. ABICyano1
ttgatttagattgttgtataacttttattttttagtctagtgggttttatattatgagtaaattattctctttgtgcatagctatactgttaaatgtcagttgcgtgggaatattactgaagtcgagtcctgttaatgctcagacgctttataatattacttataacaaacatggtagagttttaaatacgtctgagggtacattttatgttggtcgttctggagatgctatcaggagcgtgtctgggaaaaaaatatatggttattggaaagaatctaacggactactttctatttacattggcaatagaatttatagcttcaatctcagtggttcttctaattcggaacgcagacgttctattccacctgaatgtttacaatatcctgataccttttattgcagaaatatcgagcggtaggctgtagttataggctaataacaactgcctaaatcaatttccattgactaaatattttgtttaactggtgttttaccttttatggaactttctagcaggataatacattagcgaggatcaagtggacgaataacaaaaattcctatcgcctgtggaacattttgtacataactttgtaaatctttagcaacagtaacttgccctgctggagaagcatgaattaaaccagtttgattcttctgtcgataaattaaccccgtatgagtaacatctaaaccttttattttggtggtgataccgataatatcccctgatttaagttgaggataaatagattttattttattggtgggaatagaacttaagtttaatttgtttaaattttcttcaactttttttatacattgaaaattactttcattgttatttaattgaggatatttagatctatttactgtcatgaaattaagctgtttatcgagtggtattcctcctaaagacggagttaaattttttacaaatcctttgttttcattttctgctatccaatcagaaaaatagtgaaggcgatcgcaataagtaacattttgggtacggtatctttgctcttgaatatttgtaataaaagtagaataattatagtcttgaacagtaattcctttgactaaacctagtacagtctcgacaaataaaacacaatcaaatttagttaaagaaataaataaactttctttgttagtttgatccaataaaccagcttgatattttgccccgataaattgttgagctaatgtttgtataatcgtttcaagacgttgctcgtatagcttattagcctgtgctaaattcataatttgctgaaacttcttttcatctgaattattattacgaataggctttgtttctgagacaatttggacaggtaaagtattaactatagggcgactttctgttttatcttttaatgaaaaagcaataaaagaaagaaaaaacattacagaaagagaaatcgttttcgacataatttaattgaaaataaataaccaacgttatatatatatgactgtatcttttctattaaacgcttatgattagatcattataaaaaatttagaataaccatattcctacttatttttattcaaaaatacttgaaggcttttatctttaagaagcccacaccataaatctttgattttggtgctgggagtatgtcactattgccaaggatcgtaattatcaaattgtttgcaaagatagcgtccaactcttttgtcaccactatgttgtattaatagcattatacgttgtggatcatttacactataattatctataaaaccagactttcccagctcacatactgcttcataataatggttaggtactaaacgcttacctttattatcttcaagataagcaatagcacgaacagtatgtaaaccattaaaattattaatataaagacccatatcgttatgataaattacaagttttataccacttttaaaagtaaaaactgcaaccttaaaaccatttcttgtcgaaatctgctgtgaataagctggttttataagaaataaaaagaaaaataataaaattagagttactacatatcttttatacatttatcgatcacaattaccgcttgaaaaacttatttatttttcattataatccacctatcgaattatttttatactgattaattttggagaggatatactcatcaaggtcataatctgaggttttgtgaggttggtatttatagatctaaaaactcaagttatgcccttgaaaagtataaacattcagatattgatttatccaataatctattttaaagcatttttagttcctaagcgatttagattaaagattctatttgctgaatcaacttatctattttttgccatttcttctggtctttttcccatagttttgctttattcaccgtgttcactaaattttttagtctattactaggaatatccttcgtctggttaggagaaaattctttgattctattcttaatttcctgtagtgataaattagatgatataacctcttgtaataattcttctcgtttttgttcatctttaattttactgagggcgatcgcctttgtataagctattttcccctgtctaagtacctctaaaatagaatcaggtaaatgcaagagtcttaatcgatgagtcatgaaagattcaaaagtaattaagccccccaaagttttctcgataatatccttttccgatttaccgacaacgttgtcggtaacttttcctttcagttcattttgccatcggtttaaaagggaaataacctcttctatggagatctccagacgcaaagccaatagttgtaaaatcgattctgtctgctctaaagggttcaaatcctcccgttgtaaattctcggttaaagcaacctgtaacgcttcaatatcacttaactctttgataactactggtacttcgctaaattgtaattctctcgccgcccttaatcttctttctcctgctactaactcatacttcccgtcattcaatggtcttaccagtaagggttctaatataccttgttgggcaatggagtttttcaactccgccaacttaatgggatcaaaatagcgacgtggttgttgtggtggtaaaacaatattttctagggctagagtgttattagttagttcttcttttcccatcaatacgtctaaattatcttgcaccactttacttttagtgctacggtaaggtttttcagtttttctgcgaatacgagacgttgttgttttttcctgattattaggagtagtcattttccctatccctgttaagctagtctgctaataagtttacactttttggatgggaaaagagaaaaaagtgataaggattttttagacttgataaaaagatgagtgaaagggcttacctgttccctaagctaaaacgcatttaaccttcctatttaaagctctgaatcccttactgtaaggagttgaaaattgcaaaatcagtgggttctagcttatcctcacatgacgatttagatgcctataagggtaaaccagccaagaaataattagaaaaaattaaagcccaaataaaaaagttaaaatcaagaaaacggcaaagaaaaaaagatgactactcaactaaaacccaaaacctataccataacagaatatttaaaacttgaagatcaagcagacataagaaatgagtatattaatggagaaattatccccatgacaggaggtacaaccaatcataatttaataacgggtaatctttacctagccctgagattagcccttaaaggcaaaaatcaacccgtttttattgaaaatgtccgtttatttatcgctttcaataatatctttacttatcctgatgtaatggtaatggcaaacgagccagaatattacaaagaaactaaaaccaccgttactaatcccctgattattatggaagttttatccccagctaccagagattatgatttaggacaaaaatttgaatattatcgcaccctaaacagtttacaagaatatatcttagttgatcccgaaaaaaccatgattatggcttatctccgagataataaccaaagatggttactaaatatttatgaaaatttaagtgatattttacatttaaaatcaatatctttagacatccctttaaccgatatttatgaaggagttttcaattaagctaagacgcatttaactttccttttttagctctaaatctcttagtataactggttcgagatttccaaataggtgcgtcttagcttaaagctcattatgtatagaaaaagccagattattaaatatttctacccccaatgatttaggttcatattttgctaaaggtaagccttcctctgaagcatctacaaaagcagtcaaacgggggattggttcatatacttgggcgatcaaactaaattcttcctgaatagcctttaaagttcgttggtcttgggaatttgttttagaataacgagagggtataaaaccagctatgactaagtttttgttccccctttttttcacccgtgagatagtttctaataaaagattcgtcccttgaaacgctttaaagtgagtttcaatggggattaagacatgagtagaggcaattaaggcactatagctcaataaccccaaactaggagggcagtctattaggatatagtcataagcatcaagtaaaggctcgatcgcctcttttagacggacttctctaaaatcaagatttactaactgtatttccgccgccgataaactgatattggttgctactaaatcaacaccatgaatgtcaggaataatttgtaagggttgctcttcaatcaaagcattataaggagtaacttctaatgaatcggtatcaacattcataaagtgacttaaagaggattggggatctaaatctatcaataaaatcttttgcttgagcaatgataaatgataacctagattttgcgtgatggtcgttttcccgactcctcctgcttgattaaataaggcaatgactttacaacccatactctgaatgttggtatttcctctttgatattacgagcattacggcttttgttagcttaacacgaaaagaaaaaataaaatcaatcaattaatcgaaatattctcaattcgctacttacttagacttatttcttttgtgataccaagtggtaactgtcttgaaaggaactcctgtaatgcgttcgatgtcaacatagtttttaccctcatctcgtaaccttaaacattgttgttttatctcatcagaatatttgggaggtctgccagaaaaattttgagttcttttaatacccctctctctagcatattctcgcacctgatgaccagaaataccaattttttgctcaatttccttatcagaacaccccgtcaaccacatctcgatcgcttcttgcttttgctgttcagagtaaatttttttcggtcttgatataccaacttttacaacgtagtctctaatggactcgacattaattcctgtttctacttcgatgttcattggtgatataccctttaaatataactgacgaaccagctgtttttctgagtttgttgcattgtcaatggtttttaaaagtccagcgtttttaattgttcttctaatattgttagaagacttcatgcccaataactcagctattctgggtattgaatagccatttctgtacattggcacatagtagctacttcttacttcttccgaatcaattacacggggtgaaattaaaggatattcttcacctgacggtaaattctgttgcatcttttccacaaaatcgacaaaataaggacattggtgacattggggttttaaacctggttcaatacacccataatttgaatgccaattcagccttacttttgaatatgcactcatgtatttatctatcgctcttttataaaaatcttcttttatattacgcatttaatcctccaaattattttttttactggaaaaagtttcaacactggttaagactattggttagaaattaaggttaaaagcaaggtgtcaaggaattttcaaagaaaaagtttttttgattttttcccaattctggaaacggagcaataattaacccttttttgtcaaactccgcaaacatttgcaatttatagattttggatcaattgtatatcaatcgatcaaaccaatatttaatattataaaatccctcgaaacttcaaattagtaaatcttagtctgtagtatgttttgagcgctatttaccaagcaatttgaaaatatttaataatagttaaaattggaaactgacaaaagagggttaatttctgccttggttttctcttcctttttataattcctaaatctctattttctggggctgaaaaatatttaaccacctcttttgctttgcctttattgtaagcaactatatatcatttctattgagattgaatcaaatggatttgatatgaactagcttatctgaaattatgcggtaaaagagaacattgacaaacttctttgttacaagaaagttactatttaatctgtactgaaaaattagattattaggtaataattaaccttatcatcatgaaatatcattattcttattttagtttttttttcttgaaaatgaaaaactaatttgtcaaaaagtattaaactctacactttgaattttacaatttaaaactactattctttttattaatttagaatagagtaattccctttccttagtattgagagaataccaaaatcctaaatgagtgatgtggggataagataaaatatcctcagcagttgcttggacaaactcatttaaatctcgacgatttaactcttgctttatttgtacttctaagtcttgttttgccgtttctagggctttattataatgaactttcagcatttcctctatgcccactaattgctcttttagctttgtcaccgttaccgattcaagctctttttgtttaatagaagaatcataaatactactgttaaattgttgagctttttcgatgattaagtcgaataattcagactctaataaatccaaacgaatatttttcttatttgtacaacctaaccctgcacttcgacaagcataataacgatatttctgattatttttgttcacgcatttactgccacattctccacaaataatgagtccagttagctgagatctggttctcattgttcccatagttctggaattattctccagaatatttaagacctctaagtatagttcctccgataatagtttttggtctggatgagtattttcgtggatttcccattcttgtggcggtttttgtttccctcttttcttaccatcattaggttcatacttattataagctgtatgacctcgtaacactggatttataatccaatcggcaaagttttgtccagtacgccaaaataataattctggggttaacactaagtttgtatttgctctagttgaaacaccatatttttcataaagatagcgaagaacatctctgggttttcttactttcaaaaaatactcaatagcctcaatcgctatatccccctttgagagtcctcttatcaatgctgtagaattatctggtagagaataaaaagtttgataatccactggacgttcttctagtaagcaaattataggggttgtgtcaataatatacttatcattgtcagatatagtataaccccatggttgtcttccacaggcagactttttcttccgtcgatattcaaaacccctttttactctttccctcaacattcgccgctcatgtacagaaaacattaccagtaaatctgcatttaacatccccgaagcggtatcaaaatcaacatctccttggtctaataattttatttttaccaaggaagattgaaaaagatttttcaattgtatgtatataacttcgctacgagttaatcgatcccaccttgtagcaataacgatacatatttgtttattctctactaactgtattaatttgttgaactgaggacgttctgaatttgctcctgattccacgtcatagaaaatgtattctgccccagcactcttgagcctatctatttgttgctctaaagcatgacaattttctgcctgttcacgactagacactctggcatagcctacgatattatatttaaacataattaaattagaaaagttttaaaaattaattacttttattatatgtaattaattgaaaaatgtgcaaggttaaaacatctaaaatctgcacattttttattattttaatataaaaaattataaaataaataatatataaaataaaattagagcaaatttaacttgtaattatttcaagttaaattatatgaacctatttataataacttaggtcttattgaataaatagaaatcaaattaatcaatatgtatcaggaattattgtttaatttcactacataaatttttacaatttgaactaaaacactaatttcctcaaaaatagattaatatagtagttatcattaaataaatagaaatacaacaaagaaaataactaaaatttttatttatatagcagtaacagttaattttataactagaaaatcatttgggaaatatttataggttctaattggaactaatcttatttctccaacctaaaaaacattcagcaaatataataatactcaaccaaaaaatctcaacaaaacttaataattaaattttttttgagagcagtaattttgactaattcaatagagttgacattatttattgaaaaagaaaaggcttagttattctctagccgttatgtgatataaaatcacattaacagtacaagataactaagcctataatgaaaaatgacaaaaaaatttacatctcggatggaacccgagaatgaattaaaaaacatttaaacaactcggatggagccgagtataaaaaacgttaatttcatggtatcgcattttaacactaacttgaataattcaaatgatagcgattttataatctctgaccacttagaatttttaatgttatcagatataccaaaaagaagaaaagaaaaaaaatatatatgccccaattgtggtgaacatcacctatccatcaataaggacgggttgcggtatgactgctatagttgccacgataagagtgcgatcgctaaaattctttatcggttaaagcatggtgagactgaaaagaaaattgttaagcctaaatcaactagaagatggacttatacccacgaaggcaaaccatacatccaagtaaagagaattgatgacggcacgggcaaaaaagatatttaccaatatcgttatgagaaaggaaaatggttgtcaggtttaggagacaacaatgcttttcttcagtctaattgtgacttactctacatagatgaagttaagagagcgatcgcatccaatgaacttatttttatagctgaaggtgagggatgcgttgatagtttaagagaattagattttgtcgccaccactaacattggtgggtcaggaaagaattaccaagcatacgaagttttaaaggattatcagaatgtagttttatgccctgacaaagacatatcaggacttaagcacatggaagctatcgaaaagatattaagccatgaaccgatgtggttatatgtctatcctgagaaattttggaacagcttacccaattcgggggggatcgacatcgatgacctgatcagagaaaaacgcaccgatgacaagttaaccaatgagaaaattaaagaggtgattatggaattagtaggggataaaaaagagtttgccaccacgaaaaaaactgaaggtaaagttgttaatttcccttctaaaccgattgataaagatgatattcagtcaagattatcggaattattaaataaaggtttaaaaccctctcaggaaaccctagagattgtcgaaatagcaagggataacggtattcatataaacgagataaaagacatttatcggagtttgaaggatgaaaatgagtctgaagaattaacgttagatttatcagaaaaactcgaaaacatccttgacatcgagaatattaaccttgatttaccttcagtcttacctcaagagatagcgtcaaaaattattgtattagcagaagaaatgaaagtagcacctgaacatctcttaactgcgatgctaccaacgtgggcatctatgatcggcactaaatccaaaataattgtctcttctgctaaaggatatacgcaaccatcaatcttaagaacaatgattgttgctaattcgggtgatcgcaaatcaccaatcttaaagaatgctaccagtgccatagtagaaatggatgctgattcaatggcaagttttaaacaggaaatgagagattatgaggtggctttaactcaattagagaaaggacaaacaccaccagataaaccaactgctaaacgctacgttatcgatgacttcaattttgacggcatggtcaaacttcattcagaaaacgaagtcggtttattaggcactatagatgaactgaaaggatattttacccgaatgaataagcaaacgggtaaaggtgacgatgagcaaaaagatttacagctattcaatggaagtcctttaataaaagatagacaatcagaaagttgcagtttttatcttgccaaaagtgccgtaagtttagtcggtactattcaatggcaagttttgggggatctgataaagtctaaaggggaaaatgattcggctggtgtggtgtgccgttggttagtgtgtgctaaaccgttggggatgtcaaagttagatttattttcaggcaatgatgatttatttgataccttcaaaaatgaacaaaaggaattactcaaatacttacgaggtttgcccaaattagattttcttctcagtgatgatgctaagagactatggcaacaattccaacatcatttagaagatttgagggcaatagaaaccatagacgctttatcggtggcttatcccaaatttgaaagctacatgagtcgtttagcactcattcttcattgtgtggaatcgttttatacccgtgctttaaccgctactatctcaggaaaaacgatgaagcgtgcgatcaagatgacccaattttacatgaatcaatatcgttacgttttagctaaatgctcaccttctcaatctcttactggtgatattctcaagattcgagatttactgcagaaaacgggtagccttacagttactcaagttcgggataaattcagacacctgaagaaaataccaactaatgaacggaaaactattattctcagctactttgaaacattggttaactcaggttttgctcaatgggaaatcgcaggcaagaaaattgggacaaattgggacaaaaatcgggacaaattgggacaaactcaaaaaacctcacaactcattaatataaatacttctggagataccgaaaaaaataaattgggacaagttgggacaaaattgggacaccctaaaatcagtcatatcaataatttaaagactgaattgggacaaaataataaatttaactttttctcagaagattctaagttacaaaagactgaagataataattcgacttcagttaaagaagatagtaaagaaaataagatagtaagtcagaaaaattgtcccagtaacttctttaaagttaataatgacaatagtttagagcgtcccaaaaatgtcccaacttgtcccaacgaaacgctgaaacctagccatgataacactttagagcgtcccaatttttgtcccaattttgataaaagtgtcccaatttctgaaaaagatgattattttattttttcagtcaaaaatgaaaagctaaaagagaaggaaaaatgggcgcggcttaaagatggagtaacagttaaggggatgaaaactagattactcgtagatgttcatgagtctagttatggttttattaagggacgtgaatcaggcttgacttgttactatgaggtgaaaaaatctgatgtagagatatttgagggggaaaagaaaaataaatgatagacgtaaattagagtcagataagtaggaggttgttactagaagtgatataaaattgaaacttttatatagcaaagggtttagaaaactactttgccgattttacagcttccctagctttactccaatttggcggaaacatcacttatgttcagataaactgctttagggggaattatgaaggttaatggtcaaggtcaggctcgtattcttgctcctaatgaagttactgctatctttgaagaattatgtttgcgcgatcggactgtttttgctttttgtctttacgctggctgtcgtatttctgaggcggcttctattcgcatggaggatgtttctttgcgcgatcgcctcttgttacttccttctcgaaatactaaaagtcgtcagagtcgcactattcctgttaatcaggagttatcagcgatggtgaaggagtatttattggcaacgggtattcgtagagggtttatgtttcctcattgttatgaaaagggttatgagaagggctatctttcccgaactactctacattatgctttgcaaagggcttgtgagacgttgaatatgagaggcgttagtacccatagttttagacgcacctgtttgacgactatgtccaatgctggtgtgcctctgcacgttatccaagcgatttctggacatagtactctgtctgctttgcaaaagtatttaggagtgcaacctaatcagttattctcagccattgacaccatatccatgaaatcctctcctcctgcttccgattctgttttctctgggaagtttggattttaatggtaatttttttattttttgtcaaaattgcataaattccgaatcagtcactgataaataaatagataaataaatcattggtaaaaaccatgaaaatatttttgtatattgtcggtggattgtctagttttattttaatttccagtggtatttctatgacttcaattgaaagtgccgcttctgctgaaccctttggttctcgtacaattaatgaggttttttataataatattggaactggatttatcggactaggtttttttactggtccgactttaatagcattagcaaatctttctgacaaatctacagaaaaatagtatttatattttgaaaaatacaatggtaattttgatgatattattagatgaataaatagtaaaaaatatgactaattttttttctttttccctgaaaactttattaggaattggcattactttaggggctttaactattcccaaaatttctcaaaaatcaactgttttagcccagaatacgagagcggttgtttttgctcccccttccaacgttcgagcaacaccaaacggacaagttatttgtagtgttaatgccgttacttctattaatatctatggttctagtaatggttggtatgtaactgatgtttgtggtagaaatggttatatccatcatagtcaaattcgttttgaaagtagtttccaaggtgtaaaaaatccaagttgtttagtgactagcattcaaactggacagttagcggtgcgtaaaagtccaggaggagaggcgatcgcaggattaaataatgataatttagttcagtatattcaaggagattttccttggtattatatcaaagtaataaaaggaccaaatagtgcagtaaatggcagaactggatgggtaaatgctaattatttagaatgtgcttgggattaacaataaatgctaaaaacatactattataatgatttcaatttggattaaaatatctgttatttgaaatgactatagtaataaaaaaataaatgtttagttattttctcttccagaatttttttacaatttattgttatgtttatctaatataaaatgtcacaatctcggtatccagaaaactgggaagaaatagctaaacaaaggaaagaagctgttggttggaaatgtcaaaaatgtggtattcaatgtttgaaaccagaggatgatcgttcaaaattaacgatttcagaaataaaaagaagaactttggcggtacatcatgctaattatcaaccagaagataaccgccccgaaaatttgattcctctttgtagcccttgtcatctttcttatcatacgagaagaaaaggtagtgtctctctcggacaattatctttgtttgaataatgtagttatttctcttttttggggttcagagctaaatacgagtaacctgccaccctgtttgattaccgattttgccaaagcggataaacttaaaagcccctctaatccattctttgccctttggcttggttcccaataattctgctacttccttactggttagaatataaccacgttctgccgcctgatctaatttttcccaatgatcaatagggtttgagggtcttactttttctatcactttttccactgctgtttcaagggtcaattgaaaaagtgatagttggatatattctggattagtgtctaatgatgaactgacacagtctatttctgaatttacagttaaattgtctggagtagaatttacactgtctgtttctggatagacagttgttttaacagtgggagtaaaggttttgatgcttcctcctaactttaagtgttcctgtaattgatctagtgtagtcactgcatcttcggcgacgtagctcttattaccttcttttaaaacctcagctttgatagcattgatgcgatcgtacactgactgccgagattttaactcatacctatcttgtaattccttgatggagtattttttcatttgtccagttttaaatagacactatagtcagagtattttatcttaataaaccctataccagtaggttagctattttgtactttacattaggaatgaagatatttctcagggcgatcaagaccctctctatgaaatcatctcctcccccctctgattctgctttctctggtaagtttggcttctgaacttttattcattataaaagcctatagaaagaatatagtaaagatacgatcatattatcataatttttgattcaatttttccccatatttcttgattatatatacctactaaatttttacattttatcattaataaaattgcatataaatagtcaaacatttgagtaacttctgttcttgataagtcaagtttttcaggtgtaattttaaaagattctaaccagtaactgataattttttttgtataacaagtatgtgtttcttcaggttgatatttatcaggcatttcttcttttaattcttccaatgtctgaattatttgatctaagacaattttatcatatattttattttcttttgcaaaataggcatattttataaatttttcaataatattagcattagctaatgcaactggattaacataataaatatgattaggattaatttgtgtcatagcttcaatgaaaagagtattcatcgaattatccatgcaagaaagattggcaattgctatccctaaattattaggaaaaggattaatatttcctaaagaaacagcatctgttgcagaataaataattttattaggacatatacaagcaatagaaaaagccaaactaaaatttaaagctctttttccataagatggaataccaaaagaggtatgatcagttattttttgattccagttaactaaatattttaagtcaggagtattaatcaaagaattgataagttcggagattattaataaataattatctgaatcttgtattaattctgccaaaaataaaaagacttcttcatagcgtttgtcaataaaattttctttgacaaaatctttaatatttagattattttctctaatataataagcaacaaaatactcctgtaatgttaaatgagaaaaagaataatagccttctgatttttgtaaaattattccacaatttaattcaatttcttctagtataagttctggatcaatagagtcttgatttggtaaaatattttttagtatttgttctatttgcttacatatagttcgtttttcaatcaataatttatgttttttaaaattttcgtaagcgatttgagataataataatttgatatgtctattatttaaagattgataaattttatttctcgatacttgttttgatttatcccaattttgtaataaattatcaataattttttcgtataaaaacgattttttatttgataaaattgtctcgcttaaatcagttagacaaattaaagttagtaataaaggagttttagttagttccttcaaatttttatcttttaatatttctaaatattgtttttgtaattcattagatgattcaaaccatttattaataaacagttttacttgttcttgatcaaaatcattaattactaaatcgataaaattattgaaagatataaaattatagtaggctataatccgagaagaaataataaagcgattctttggatattgatcttgtaaatttctaatttcttcagttattatacttattttatcttttaatatttcatctaaaccatctaaaagaattaataaattaccttcttttaaaaaatgtttagtaaactcctgatttatatttattccacagttatttaattctttggttattccttctaataaattaaatttttcatttcctattattaacttatttaactctaaaaatattggaatataaatagatgtatttttatctttttcttgatttatttttaatacttctaacccaagtttttttagaaaagtagttttaccactaccagcattacctaaaattacaaagtttccttttctttctaatatgtcaattatattgcattcatatttatggtctttagaatgaaacttgatgtcagtataaatagaatctaatttttttggttctgacattcctaaaactttcacaagaccatatcgtttaataaatgttttactatattcagaatttttccccctaaatttcttcttttcacgaaaataaaatatgtttatttttgtgaatgatatattttttaagaatttgcaaaaaaaatcaataaaactcccgaaaatttttgtaaaaataattttttgtattaattcaaaagtcattttatctagtacgtcaattattagaatttagataataaaaactactgtagcaatcttatttaagttgtgacgcaataactattatactagaaaaaaaagtaatctctccatcgaagaattatctctatttgactagatagccttgatttaatttacatttaagtcatagatatactgatagacttgggtacatttctgctcgtataattccactgaataactttcgggaagacgatcgagcatatctttgatggtaatctctacattagcccttgtctgttgtctcttacgccagtcgattaccaatttctctcgtttgaggatggttaataattctctcacgatttgtttaacgtttttttcttccttttggcttaggttaatattgggtttggttagcaagtcgaaaatcgctaattcttcctccgtcagtttttccccgactgcccttttctcttcttcattcaattcttgggctaattcaattaactggttaaataaccattccacgttgtgactacctgaattatagtcttggatcatttgttgatacttctcatagtaattcaggcgacttttattcactgttaacatttcctttacctttctctctacgagggcttttaacctctctgtttgggtgttttttgtttgcccctcttgaaattctgcttctagttggtttaagtctaactggcttaaatctaccagttgtcggggggtggagggtataataaattctcctgcaacgatcgattctgctagtaattcctctatctctgttttcgtttctgatatatcaatttggggtatctcttgtttaatctttagtctcagtctttcgagtatttgttgtgtgggggcaaattcggaggcggtagtatcgggtaaaatagctttatataaacgggtaacgttattacagtgggcgaagaaagtttttaaagtctcctcattaatcaatatggcttctatggcatcttcccataccttcactttctcaaaggcggttttttggatggtggttaatgattctaagttaatccctattttacggcagaaggcgatcgcctcttggctgacttcccttaacttttcgatgagggcagttttagctaatacgggattatccccctcgtcaacacctcccccagaaactgaaccatatattgctaaagcgtctttgaggttacgaaataccccaatataatccactatcaaaccgtttaccttatctttaaatactcgattagctcgtgcgatcgtttgcatcagggtatggtttttcatgggtttatcaaggtaaacgatggcacaactgggggcatcaaagcccgttatccacatggcacaaacaaaaacgattcttaaggggttattagcgtctttgaattgttcatcgaggggttgggatttatccgctagtctttgacggtggcgagttatatctaatcctttctgtctaaaatccgctacttcgttttgactggaagaaattactactgccatgtctgtttcttccatgtactttatctgtttactaattcttttgatttcaaattcacttaaattaggttgtcgtattttttgttgtaattgagttaaatcttcttgccaatatttctgtactaaatcatacattttaacggtggaaaagcgatcgatgctaattaccattgctttttcttggtagcctctccctaaaaagtgactgactatatcacgggcgattttatccagtcggttaggattaataatgaggttatattctctggtgcattgactctggagtaatttttctgcttcctcgtctaataaggcattgtcaataatatcttgcatttcctcgttaagttgctcattggttagctgtaactctgggatgcgattttcataataaaggggtacggttgccccgtcttccactgactgacggaagttataaacactgacataatctccgaaaacttctttagttttttcttcccctgccattaaaggtgtgcctgtaaagccgataaaacaggcgttaggtagggcgtttctcaggttgagggcaaaagtatcatattggctacggtgggcttcatcggcaataacaatgatgtctgagcgagttgatagttgggggtagttttcccctttgttggtacggaatttttgaatgagggtaaatatataacgatgatcttcttgtagtaattgttgcagatgttgggcgctgtttgccctaacgctttcttcagcttcggtgacggcttctacataggcgaagttttggtaaatctgtttgtctaagtcttctctgtcggtgataattaagaatgtccagtttccccttagtttccgtagtatcttctgggcaaaaaataccatactataggattttccgcttccttgggtgtgccagaatacccctagttttccttgattggtgctaatattgttaactgcttctatggctttatttacccctaggaattgatgattcttggcgactatcttaatcattttgcccttttcggttttaaatagggtgaagttttcgatgatgtcgaggagatattgtggctgacaagtacctctaattatggtatcaagggaaattatccctgtctctccttcactgttaatctttttccattcactaaaatgttcaaagggggaggtaatactgccgatgcgacttttactgccgttggaaaggatgataatggcgttataccagaatagttgcggtatggtagttttatagtctcgcaggttgtcgtcataggctttttcaaggcggttatggtggcttttgagttctataaacacaaggggtaaaccgttaataaagccgattaaatccgcccttctgctatatatttctccttctaaccaaaattgggaggcaaggaaaaagtaattgttattagggttatgccagtctataatttttactgtgtcgatctgctcttggttatcttggtttggatagctaactttaattccttcttttaataatttatatatctctcggttggcattctctaagctgagagtataacgtggttgggtgatttgtgcgatcgcgctctggagggcggtttctggtaattctgggttaagcgtggttaatgcttggtgtagctgaggggttaacactacttcttttctactttttctccctaatgggttactatctcctactttttcatcatagctatttaaagtttgccatcctaattgttcaaaaagtgcgatcgcttctaattctaaggcattttcggagtcgggattataatttgtcataaactaaaaaatcgctccttagttaatagtgaaaaagatattgagagtattattaatataaatattgttccatattttcggttaaatttccttgattaactacagcgataaagtctgcttaatcaacaatggcgtttatgttttggctgggaaaatggtactgcttttgatgtagaaatagttgattatcattaaaatattatgagtgattctgtgattaaaaacccccatgctggagaaattctgaagtgtgaatttttggatgagttaggtatgagtcaaaatgccctcgcccatgctatcaatgttcctcctaatcgtattcatgccatcgttaacggaaatcgaggtataactgccgatacggatttaaggttatgtcgttattttgggctatcggaaggctattttttacgtttacaaaatagttatcagttactagaggcaaagcggaagttaggagaaaggttaaatgttattactccccttatttcaacctaagtcacaagtaataagtttaactggttaatctctctgtattaatatcaaggttttctacgtctatctcccctgatattagtttcggtaatagcaagtcacgagtttttctaaggttaatatttttttctgttaatatttctaagttacgaaaaataggctgtatcaaaaactcaaattcattgacaatatcaatagatggttgaattagctttatattttccatatctgcttttgttacagatttaaaaatcgtacctcctcccattaaatcatcctcattaaattttgcttttagttgttgatataaaaatatttgattattcgtaagacttttaatagcagacaaaccacgaccaattacaatctttttattagcaatattaattctcccaacgggcgcacgaacactaaaaagaatatctccagcttctgcaattcgattaaatactgttgtataaactttatctataggaaatctatcagtaaagttactaactccttgatgaaaaggtaatcctacccctgtctcattataaaactccgactttggagattgacccattacaagtttacaaacatcgttcagtttcttaacctgccaaccttcaggaattaaacctaattcagattcaaccattttgacgttttcatggttagggaagcggaatttaacaaaccattcttgataaacagtttttgccatctcctctagtatctttatccttctattattattctcgattaagtcatcataatttgataatatcgatgcgatcgctctctgtattggtagtgggggaggatctatttcaatttgagaaaaaacattaatgtcaactctttgccttccagatgctcccgtcatacttttgattgcaggtgattttatcaaatcacttgaagccaaatagtaaatataatcaggatcagaaatattattttttgctctaaaaacaataaattctgttgaaccaaaacccaaactagatacatttttaacttgagcaattttgccattttctaaacaaggagtaattctggcaaaaagtacatctttattggtgaattttgaacctcctccattaaagatttgctttgaattaggactaacatatttattacatggattaatcattgccatgtcaatatgataatattcttgtttttttgataggctatatcttggattaatttctacaaattcagtaaaaagcatattttaactttgtgaaaacaaaataacattcaatctaataagaggataagctgagatcgtcttttaatatattatgataagggggagcgatcgcattctaactattaacctaacccaagatgtaaattaagagcgagattaaccaaattcataagctccccagagagagtacccaccacatcaccctgtaacctttcttttgaaatagtcctaacctgctgtgcttgaatcttggagtcttgaggtaaacccgaatcccccttactaataaacacctcaaaaggataaaccctcgtcactttagaagttatgggtaacaccgttacagtggaagccacccgattattaatatcattgctcacgattaacacagggcgagttttagccacctctgaaccaatagtaggactaagattagcatagaatatatcaccacgtttcatcacctaaaccgtctcctgctaccacatcccaatcagaatcaatctccttgtcagcttccttataggcattttccaaatcttgcgcacgcagtaacattaacgcctcctctactacctgtgaagaagacttacacttcctactatttttataactatcgatgaataccaccaaatcctcagaaatggacaccgacatttttcttgccgtcattgcttacctattagtcaataaaattgttattactttatcttactactttttgcccataattattcttaggtcaattttttatggtaaagttggctcgtcctatggcattttcagatagtctctgacggatattatacttgaatgaaattatgaggttcagttattctgatcaaaaattctttaacttttggatatttggaatctccttcttgaattaggttgataatttttttatttccttgaagactttcttgaaagaggttagctaaactctgttttacttgctcagaaggaagctgactcgtgatgaagtttataatttgtccagtttcagggtttttttcatttttttcattttcaattaaagctaatataccacgatccttgaaagctggtttcttaattttgttttcaattgtttttgcctgaatatacttgaattccgtatttgaattttcatttctcttttttaaaatttcattaaccaattcacataaaacgtgagggtaaacaaaatcttcaacttgccagtcgcaatttgttttttgaatatttgattcgtcattactttctcccataaaattaggtaataactctttatgaatctgcaaattgctatatttatttatctttatttttggatagacttctcgacctttattatcattatcgagtaatacaatcaagcaaggtttattatttttattttgataaaatgactgataaaactctagatattttaaaatattatctgcaccattagcagtaataattttagggacattgagcctaaaaaaacggcataaattttctatataaattttatctgagcttccttcaacaattatgttatagctatctaataattcataatctaagtcttcaattcctagataatctctaattttacgagtgccgtctatcttgtcaatttcgaccactttagtatctagaacattaaattctctgtttcttcttttataatgcttctgagtaatttctagctctaataaatagacattatccaatgtataagagtctataaaaacgggtgaatgtgtggtgacaaaaatttgtgctttctctgtaagttctttaagatgctttaacagttttttttgtaaaccttggtgaagataaacatctggttcatcaatcataaaaattactgatttagacttggttttttcaataattctatgatgtaacaaaatatacgctaatcgttgtaaaccagaacctttaccttctatatgttgattagagccatcattaataaagaaaactatttcatcactgattaaatctctaaatttcttaatatctgtatcaatatcaaagctaactccccagttttttcgatattcctgaaataagggattaatttcattagataaagtagttaaaacctctaataaaccttgtgtgtatttttcaaaactattctttaattctgatttcaagcctataaatctagatttatcatattctatatcgtaaatatcttctataatactattaataactttaggaaaagatatatttatagattcgataaaaaagaattctattttttttaataaattatctatttcactttcatttatatcctcatttctacttctaatattacttttaagttttttgcctgttgtcttttctaattcagtcagattaaataatcgctctattctataaatatcattattagacagcaaaaaattaatagatattttaggcgcagtggcaccccctcgactaccttcaagtttgtgaaatgggatatctgcttcgggattatactgatcagggttaaaaaataaatttatcgctcttagtgtgttagttttgcctgtattattttctccacatatagtaatgaagttattattatcgttaaattccagtttgagatttaaaatcgagcgatatctttcaatttgaattgttttaattttaatcatattttttttataactcagggtttacgtctcatctgtgctaaaaacaatgttaggagacttgcgatcgcttgaaaacttctttctaacccctaacatctaacaactgagagacattaagggcgatcgccccttctaactctcgtgcctcagaattaaggatttccaactcctcgtttaactcctccaaacgctcagtaaaatcaaaatcttcctcctctttttgagctacccccacataacgccccggattgagactccatccttgagcttcaatttctgagatagtggctaccttacataaccctgccacatccacatattgcccttcagggaagttttctttaaacaggggagactgataaaccgtctctggcttttcaccccgatataacctgacaatattagcgataaactcgatttgctcagggataaattcccgatgcgccctgtcaatttggttatagatatgtcgtgcatcaataaacaataccttatcacggcgaatagtatcccgtttccccttatccaaaaaccagagagtacaaggtaaggtgacagtatagaagaaattagaacccaccgcaatcatcacatctactactccagagttaattaacttctgacggatagttaactctgaactacgggcatcactagcggagttagccataacaaaaccagcccttcccttgtcatttaaggcactgtagaaaaaatgaatccagatataattggcattatccgccgtaggcattcccaaatctgccacccgtaaatccttattcatcttctccttatccaccttatccacattgaaagggggattagccatgacaaaatcaaacttacctaccgcctcgtgtatatcctcatagtaagtattgctttccttaatgtcacccgataaaccatgtaccgccaaattcatcttacagagtctcacagtatctcttgtcttctcctgcccataaatacttatttcactactagggtttttctgatgcctagcgataaagtcagcactctgtacaaacataccccctgaaccacaagcggggtcatatatacgtccgtgatagggttcgattatttcgacaattaatttaacaatggaagtaggcgtaaaaaattcgccccctttttgcccttcactcatggcaaacttaccgaggaagtattcataaattttaccgaagacatccccttctaaatcatttcccatatcaatttggttaaagtttttcagtaactccaccaacaggctattgtcaaagcgattatagttttggggtaaaactcccgttaattcctcattttccttctcgatcgctctcatagcttcattaatcgccttacctatatcctgactttctgacagactgactagataggaaaaacgagcattttcgggtaaaaacataactcctagggcttgatagtcagcctttgacactccccgtctcgaagaagttttactcttgaactgcgactgtgccttttggaagcgataatcagcataacgcagaaaaattaaccctaacacaggagttgaatattccgatgattttagggcggaattagatcttaaattatcagccgcatcccaaagacgagtttctaaattgttattattacctgacattaaattgtttgacaaacaaatatacttatatttactcattgtaccaagaatcgatcgcgcctcagtctgaattagagaaatagtgacagagtagaggaataaccgaatcataccaccgcagttgagcgccctgccaaccatcagcggaggtggttaataaagcaataccatactgtttacccttatcggttaattttctctctcggtttacccctggttttgcccaatcctgtaactccaaatcatgtaaggcttggtttaccttagcaggtgttaccttagtacctaacttagttgataactctgttgctaactggctagtaatcatccctgtaggggaggaactattattagtgatggtttccagtgccgatgttactacccccgccaatgctggtatctgtttggctaattccttcaacttccaagaggcgatcgccctctcatctattcctgcttctgccatccaaactgaagccatttcaataccatcagctatcaattttacctcatcagtccccaagttaggaagaatagaggggcgttgttcatcagtatcggacattgaggcgcgatcgtatctatcttttatttgcatggatgcaaagataaaatctagcgtatcttcgtccaatcataagaattgacctgcttaccattcttatcagtttttgtggttgtttttagtttcatataatcccaaaactctggaaaaggtgcttttttctttccattagctaactctgaagcccttgcagaggaactaaaaccaagagctttggctaacatcttagttcccaccttaccttttggtaaagccaaaaagtccgcaggaatatgactaacatcggcttggttattaactttgctcctatctaaagtaataactaattgagaagtaagattttcctccgtaatggttgacatagaagaatccttgacctctggttttttctcatcattctcaattaccttattactaactttattctgaccctttttagtgggagaaatattctccttacttactttcttaacttggttagtatctttactaacatctttttcatttaagttatcaactaagtcaatgcctttattgctatcttccctatttaagtcattaacttggttaatatcttcgttactatcttttttattatttttgttaaagttattaacttggttagtatttttattaatatctttcttgtttaagttatcaactaactcaacatctttatcactacccttcctatttaagctattaacttcgttaatatctttgttactaactagctcatattcctttttctgtttatcctctagttgctcaccctgcactggtagagaaaaaacttcttcctcatcgtcagtaactacttttaactctccatcatcagcaatattgccctcagccaaactttcatcatcttccccatcattagttactaactcattcttaactaagttatcatttaatcctactttcttattatccgtatttgataaaggtcttaacttattctctactaagttattaactaaatcatctaaatgaatatctaaaaattcctgtactttccgtgccaccaaagcatctaaatctaactgttcaaattgtaagaggcgatcgcgcagagtcctatccctgtctcctaaaattggcttacctgcatcgtgccacgcctccaataaccgccctaacacccttgccttagaaatcccctcatggagggcgataaactcatcaagaattgaaagctgatgctcactaatcaaaccagaatatttcggtaacgaactaggcataatcaataagtcttaactttattactaactagataataacgaatctacttatctttaagacaattaaagttcctcaagactccatgagacattattaccatttccattttcaaaccaagaaaaaagtttaccctcccccttgacatcatttagtttagtacggcatactcaaattattatcaactaggaaaataaactataaaaaaatggaggaaaactcaaacaatactgattaccgaaaagaattagagaaattagcttcctactttgaaacagagccaaacaaaaaagaagagacatttttttttgcttacagttaataggattctgtcggctattagttgatgactcaatcttgaggcaaaactttttcccaactacttcggtagagtcaaatattctcaatcatatacctcgaagttatgaagaactaaagaagtattttgattttcttgttgaaatgaaagacaagaattttaattactcagcatttgtaccactcaaattacatattagcgataagtctttagttcaagccataggggtattgtcaacggaatggacagaaaaaggaattaaacagttccgaattacagaaggtattttgaatattttttcagaaacgggagaatttttaacttctgagaaattgatagtaggaagatttctaattcctagagaattgatcaagctaatgatccaattagctgatatagataaaggtgatgaaatttattgtccttatgattctttaggtaaattcgccttagaaatcatagaacaagatggacatccctacctagaaatattaggaaatattccaattatctatctggttaacatcctcaacgaaattgatattcaggttagttatagtcatcctatttataacccaagttatatagaaagtgaaaaacggaaaccatttgccaaaagcatttgcattcttcctactggcattaaatacaacaaaaagctgattaatgaaagtttggaaaatttttcactacctcttaacagttggattcatagtgatgcctatgcccttgaatgtcttttagctcagacgaaaaaccgtgctgttattgcacttaatagtacatttttattaagtgcaaaagttcaacaatttcgtgaaagtttggttaagagaaatcttgttgagacagttatcagtttgccttcgggaacaattccttatattttatcccaattctccattatggtattgaacaagaataaaggtaatgacaataatattcgttttatcaatggtataaatgaaaagttttggattcgagaaaatcatcaacctaaattagttcaatgggaatcattaattaaagttagtcgctctgaggctgatgagtttattgttattgatgttagtaaagaaaaggtactggaaaataaaagtagcttagatgttgctcaatatatatattcttctaaagagaaaaaagttgagcaattactttcaaatcaaacaaccaaaactttggctgaagtagtgaatattatttctcctgtttctagtagccacatccgtaataactcatcagacaaaattaaagtcaaggaaatcaccattgatgactttcctgattatgggtatttatctagccctaccaaagagatagatacgattaattacaagcaaaatgaacactttttacgaccctacgacattgttattgtgacaaaaggaagtgtgggtaaagtgggcattactcctccagatgtgccagcgatgggtgaaggaggttgggttgtcaatcaatcttattcaattcttagggctggaaaagaaataagtgccattagtttatatatgtatcttatttctgaagtgggtcagaatgctatttcgaggttagtttcaaaggcaactagacctctaattagacaaggtgaactcaaatatttacccataatcataccaactactgaagaagcccaagagattgagaaaacctttaaccgtatggtgaaaatcaattgtcttaaaagtaagttggtagaaaaacaacaagaactacgcaaaaaacactggtcactatctaagtatgaaaaataattctctggcgggaaatatggaaatcctgaaaatcaaaatttcttaccaattaaaagaggacattaaaactcttgcttatatcaaaggtattactatgaccaaactggtaacagaaattttaggaaatgcttgtcaaaaagctcgtgaaaaaattgaagagattcgttctttaagagcaaaaaaatggagagtacctattttcagaagttaaaactacctcaagccatctaaatatagaaaaagtactagaaaaattactaatttgaaaaatactttttccttaaaagtctttataaataaatgcaaagacaattaactacgctactcatatgagacgagcttcaactggcttcagaatcaaaaactttagaagaagttaagtgcaatgaagacgttggacaaaaaactaacaatcactctgatattgaagaaatatctactccgcctttacaagagaaagagaaattttctaaaaatgaagctaatttattagatgaaaaatcgtcagtaaatagtaatgaagagtctgatagtccaccttgtgtggacataatatctgagaccaatggctacgagcaattacctctaaattctaaacctgattcagatctaagtttatctagcgattcaatgatgaaaacaattaatgataatcccgtaaaaccattgactgataacaaatctaaacatggcattatacaatcacttgagattagtaagatcatcgccactgatgaaacccagtcaagatgtaaattacattcaaaaactattaaggaatatacggaattaatgaagtctggagtaacacttcctcctgtgactatttatgatgacggtgaaaaccactatttagctgatggatttcatcgtttagaggcagccaaaaaatgtggtctatcaacaattaaggctgaagtcaaacaaggttcaaaatccgatgctatcctttattcagtaggtgctaacgcaactcatggtttacgcagaacatctgccgataagagaaaagccgtcgaaactgtgttaaagaatgagaaatggagggagtggagtgataatgaaattgctaaacggtgtggtgttagccatccctttgtgggtaacattagaaaagaattgtatcccaatacggaatctgaagaaagaacttatactgacaagcatggtaatattgttaccatgaaaactggtaatattggcaaaaattctaacaaaaccagtaaaagtaaaacacaagtcgttgaaacgacagagtttactttattcgatatagaatcctcaactcaacctgttaccactcatgagaataaggaagataaaaataataccattgataagagacgttatgtcgaatgtcttcaagaaagtttcgagtttgtcaaaacggaaatattaagggttgcatcttcttctgctgctcaggaaactcaaataagagatgcgtttaacttaattcatggtgttttaacgggttatcttgaagaattgtcttaatttttcattgttctgccaagaatgtgataaagtaataccaacaaaagcaaacatctgttggcagatactttccctatgactattgatacttatcctaagttaaccaatgctaatactgattttgatttggttcgctggtgggtatctactaagtctgttagcagtcgtaaaacttatttgatggtgtataagcagttttctgagtttactggtaaggctttggcagatattgtcatcgaagatattttactctggttggagtcttatcagttacggggggcttctcttaatactattcgtaataagtcttctgccattaagtctctatttaattttgcctgtaaaactggttatctgtccactaatcctagtagtttaatcaagtctgttcagggtaagtatgctctccatgaaagaaggatgagtgaggaggaagttaaaatgttaattatggcggctcgtactcctttggagcaaatggtgattaagttgctctattttttgggtttaagggtttcagaaatgttggatttgaagtggtctcattttcagcctgtggaggggggatattctgtggaggttattggtaaggggatgaagcatcgaattttgtttcttaatcattctctctgggaacagcttcagtctttacctcgtatggagggggctgattttgtttttattaccagtaagggacatcgatatgaccgtcatagtattcatcgtgttataaaaggggttgtccatcgggctggggttaatccccaaatttctgctcactggttacgtcatgcccatgcttctcatagtcttaagcatggagcttccattgagttgttaatgaagtcgttaggtcattcttctttggatttgacttctcgttatctccatattgacgctaatcaatgtaccagtaagtttctcaatatggatgattaactaagactcagggctgagatacgtaaataacctgagttttgaataagctgaaagcattattttctcgtagtcagaaaaccttatagcttcttcttagaaataacgataaaattgccttaacccgaactgacgttaaatatattcaacccctaccatctgcaatctgcaacctgatacctaaccttgttggatattcttaaaccgaactgaggttaaatatttaattcgtaacaactttaggataagagtacgatcgcactcttatagactaatacttgttgggtcagaaaatataagagtaactaataatgttttttatttctaaatgtatttaagttttatcttgtaaaagtagatgtgggttaagtacttgatatgatttagttttagctaagttattgccgccatacgtaaacaccgtaattttgtaagagatttaatataaaaactctactatccctataattttttctattaaactataaaatcttggatgactactttttataaaagaaacataaaaaggagaataacattcaatattatttatataatctgtattgtaaaaatttttagactgaactattccatctattattatcatcaaagttacacttttgatcaaatctttaattgctcctaaatgaggcgtgtcaaaatcattgatcaattccaaaagatattgtccaaagttaattgtacgattacatattttatcaagtttccatgaacaagatgtaatagtaaagagagtgttttcaccattttttttatcactaacaacgtcttctaaatcatcaataagttgaagaaaaactccaaaagcaaataaaaaataatcatggctttcatgtagcaatccagcaactaaataaccatctgttaaaacggaagagcctcctttttgaaaagtgattcccagcacatctaattcgtaaggagagatatttttgtgtaaataaatactattcttttgagcgttatgcgttaataatatgtttgaataaattaaaggatttaaagttctatcatattgtctttctatcaattctattaaattgtaaataatttgttcatcggaatttactggagacaagttaaatccttttaatcttttttctaatctctctataaaatataatttttcttgactgttaatgtctggagaatctaaatagttatctgtataggagtataaaagactataagcaaaaattgaaggtgttaattttatttccaaatttaacaaaatttgtattaagtacattactccaacatttcttaaagattgaaaaacactttctacactaattttttggtcaaattcttttgctttattaataaaactgataacggcatcaaaaaaacctgaagaaaacataatttcaaaatgttcattttgaaacttgaatactatttgagtaaagtactttattttagcagaaatttctgtttcaaaaatattgactaattcttcattattaatagacccttctgataattttaaaaaacattcgtaaataaccccttcaatatcatctaagaattgatctaaagctttttgattatttaatttttcccttttattaattttttctcccatattgggaaactcagtttcagtattccaccatttatttaaaagactactgtgtatagcgttaaatcttgtcatatcgatttcaaaaaacgagttatgataatactatcatatccaatcataattaattaaaagtaatatcttaggtatgcgtaattacattaagtatttgttattctttggttttattttttcgcttcctataaaacctttattagcacaacaagtagaaagaccaattcaaggttgtacaataaaatctgataatttagaacaaggtttttctattttaaaaaatcctaacaatcaagaaggttgtagatttgaccatacttttagtaaaagttctgttaattatcttttaaatgtggatttatatgacggagaaaatcctaattcaaaaattgaagtaataaatattaataataatcaacaatatagttttaaaataccttactttgattggagaacaggattggatattaattttattaatctttatcagactgatagaccatcccttgttatacagcgtagtgaatctagtcaaggagcaggagggtgttatacggatatagttttttttgatcctagtataatatctggttataataaggttagtgctgaacaagtaaatttaggtgattctaagggttcaatacgtacttgtttcgagtatgaagatatagatggggatggtattatggaagtcttaggtcatgattttagatttgcttataagtttagtagtggagcaggttctggaatacctaaaaaagtgatgaaattaaagcctaatggtttagttgacgtttccagaaactataaaggttttctgagaaaacaagcatctgagttttgggatgatgttttggaacaaagcagaaattataaattttattattatggatctatgactggttatatggctgtaaaaactttattgggagaatataaagatgcaaagtctctagttattaaaagaataaaagctgatggtcaaactaatactccagaagcgaaagaatttttgtctggtattgataatttattacgtcaaacaaaatacttaaaataggtttttataa

SEQ ID NO: 3 - protein, 1061 aa, Cyanobacterium sp. ABICyano1
MILGKPSNSQPLNKRNFQNPDHIKEWQQSAISQDLIAENLVSVANGFDVLFIGNKYRTNTGVLSRHILNSYSHLEDGGSYGRTFDPFTNKEMQWVQFKPNRPRKGSTGKVIKYESPKGEPTRVLMPFVPMKIWQRISDKFGVPINPKKDTHFWEWVKNNPSIPIAITEGNKKANCLLSYGYPAIAFVGIWNGLEKINDFSKEKQLKEDLKWLLSNGNRNINIIFDQDQKQKTVINVNKAIFALSSLISRNGHKVNIVQWLPSKGKGIDDYLVALPFEKRENHLDNLIKIAPSFNFWSTKYLFKCRKPDLTVNCRYLSDAVKELPQEDIALIAPHGTGKTSLVATHVKNRSYHGRKTISLVHLESLAKANGNALGLYYRTENNIEKQYLGFSLCVDSCRDKINGITTDIISGQDYCLFIDEIDQVIPHILNSETEVSKYRCTIIDTFSELVRNAEQVIIADADLSDVTIDLIENIRGKKLYVIKNEYQYQGMTFNAVGSPLEMMAMMGKSVSEGKKLFINTTSQKAKSKYGTIALESYIFGLNKEAKILRIDSETTKNPEHPAYKIIDQDLNNILKDYDYVIASPCLQTGVSITLKGHFDQQFNFSSGNITPHCFLQQMWRLRDAEIERFYYVPNSSNLNLIGNKSSSPSDLLKSNNKMATATVNLLGRIDSEYSLEYESHGIWLETWAKLSARHNSSMRCYSEILTYLITSQGHKLNINIPSPLADIKKLNDEVSSNREKVKNERYSQRLNSPDINDAEATILESKEQKIGLTLNERCTLEKHKVKKRYGNVKMDILTFDDDGLYPKLRLFYYLTIGKPHLKANDRKAIAKMGNDNKGKILSKDLVNKTYSARVKVLEILKLTDFIDNLRDELLITPNNPAITDFNNLLLRAKKDLRVLGVNIGKYPMANINAVLTLIGHKLSVMRDEFGKEKRIKVDGKSYRCYQLETLPDFTNDTLDYWLENDSQKEVTATENYSENFNPSNSYNPDSKTLSEGANFLYINKEELHPNKLHLEIKEGAELFLFGVKVIVKGILDGAVTIFSMGQEYDLSLNELEGMLTS

SEQ ID NO: 4 - protein, 61 aa, Cyanobacterium sp. ABICyano1
MLNDGTFVQIFDIYHDHALGVTLDLKTEKIISDDVRVITVKDLLFDGTYKGVKSFMPDNAR

SEQ ID NO: 5 - protein, 254 aa, Cyanobacterium sp. ABICyano1
MNKTSKGLNRYEIHLSDKLMSEIESIAMMEGAKVHHISKKPIIKDTVISLLELGIKAVYEGVELPKKPNDTNTDNDNRINLSVLDNRIEEKLKPLYSLVSELTDKLNRIANTDKDSYSDIDTDTVTEYELIGIEKTEDSLVTSILDNVQTEEKAPSECPTLPPDEDLGDKLPEREIMVKIERLINELGIQEGLIEKEGKEKLAKLCTEIIGKKVTVERLSRVAKGTELFIAPCEFWHFFKAERDGNKWAWTRIK

SEQ ID NO: 6 - protein, 228 aa, Cyanobacterium sp. ABICyano1
MVKKLVGYVRVSSESQEDNTSLQNQIERIEAYCMAFGYELVKIFKEVATGTKADIETRPIFNEAIEYLKQDNANGIIALKLDRIARNALDVLRLVRETLEPQNKMLVLLDIQVDTSTPSGKMILTVMSAVAELERDMIYDRTQGGRKTKAQKGGYAYGKPKFGYKTEEKELKEDSAQQETIKLIKRHRRSGKSYQKIADYLNAQSIPTKQGKKWSSSVVYRICQEKAG

SEQ ID NO: 7 - protein, 87 aa, Cyanobacterium sp. ABICyano1
MNNKYLWTNHARKRLTERWEIKESWVIDTIENPERSEFIVDESGEKYHYYKRIAKFKNRVLEVITSANSTPTRIITFYFNRNMRKNL

SEQ ID NO: 8 - protein, 82 aa, Cyanobacterium sp. ABICyano1
MIVTYDNEVDAIYFKLTENKIDSTEPQTDRIIIDYDESNNIVGIEVLDFNYLVKKGLTVADLPFSEDERLTASQYFNFPVAI

SEQ ID NO: 9 - DNA, 327 bp, Cyanobacterium sp. ABICyano1
tgagaaaaagtgtaaacaaatattaagaaaaagatcagaaaaatttaacaacacgtaataaaaaaatgcgtcactacgggttataaatttacatgaaaggttaaaacacttttctgagacgattttgataaaaaagttgtcaaaaaattaagtttctttacaaatgcttaacaaaaacttggttttaagcacaaaataagagagactaatttgcagaagttttacaaggaaatcttgaagaaaaagatctaagtaaaacgactctgtttaaccaaaatttaacaaatttaacaaaacaaactaaatctattaggagattaactaagc

SEQ ID NO: 10 - DNA, 283 bp, Cyanobacterium sp. ABICyano1
tcgacaattaataacttcttcctgtacgggcgaatggccatttgctcctaactaactccgtactgctttgcggaacgagcgtagcgaactctccgaattactaagccttcatccctgatagatgcaaaaaacgaattaaaattatgtgtaaaaagaaaatgtgtctttatttagtagtcaaagttacaaaatattaagaatcaaattaataatgtattgggcagttaagtatataagtctttaaatatttatttgtattcaatatattaaccgaggacaaatt

SEQ ID NO: 11 - DNA, 205 bp, Cyanobacterium sp. ABICyano1
tagagtatgataaaatgacaaggaaaggattattttctcttgtttaaattctcaagattcttatgcttatttattttatgtaagtgtctcttttccttgaaatagaaagaaaaaagtggctaattttgagaaaagctaacaacgctttggttaactaaaaatcaaaagtgagattactgatcgcttaagaaatggagtattgatt

SEQ ID NO: 12 - DNA, 214 bp, Cyanobacterium sp. ABICyano1
agagttatatttacatagtgtgtgcgagtaagggcaacttttgtaggtagatgaataaacctcaaattactcatcttaaaagacgatatttttaatctattcttctgtaataaaatacttctttcgatagagatatttaatacttttgagagatgaaaataatttcaataattgtcatgatagagagtaagtgcaaataagaaaaaattgattt

SEQ ID NO: 13 - DNA, 338 bp, Cyanobacterium sp. ABICyano1
gcagttagataaataagtaatgagcgggagaaataggggcaaatggccattcgcccctacagggaggtggcaggtgttagggtgtttaggggatgaggtgatgagggtagagggagataaggtgtcgggtttcagatttcaggttttagaagaaagtaacgagtaattatcaactattcactattcactattgcctgttgcccttctctccttgaaatataaaaaaatgtaaaaatatcattaagaaaagtaacaaaataaacagaaaggttgacaaagttgacgctttaatatccgtatgttagctttataacaacgaaatcaacggaggagtgaaa

SEQ ID NO: 14 - DNA, 408 bp, Cyanobacterium sp. ABICyano1
cttgaaaaagttgaggtattaatagagcttgataaatgataataaaaacagatttagctcttattttaagggaaaaagaaataaataaaatattagtaaatatcaaaaatatcagcctttcaaaaataatttgactcttttcaaaaaaaaatgttatctttaaggtatgctttaaaccttaaatacttctattggtaacactgttctcaatcttatttcagattttcccattgagcataaataaaatattaagcagaagtagaaaaggttgatattagcaataataaaaattaacaataaaatgtgaaaacagattactactgattatttattgccatgagctaattagtaataatttgtcttttttgatcgaaaaatgaaattttttaagcggaggaactgaaaatt

SEQ ID NO: 15 - DNA, 411 bp, Cyanobacterium sp. ABICyano1
tatttatatataaactcgaataaaattatcaatataaagtcaaactatatctatcctattttaactgctattggtaagtcccttaattagtgttggggtgaatagattttaaaagggcaaacccccctttatcctccctcgagaggggggagggcaaaaggcaaggggcaagggaaaaattaagaattaagaattaaaaactccgaacacctgtaggggcgaatagccattcgcttcccctcatccccccatctccccaacaccctaagcccctactcgttactcatttatttacatcatttatttacatcattaagaaaagtaacaaattttgacaagtagtcttttgacaggaaaaagcaaattctcgaagatgaaaacaatagaaaaaaattcaatcttacagtaacg

SEQ ID NO: 16 - DNA, 211 bp, Cyanobacterium sp. ABICyano1
gtgatatttggtttattctatattttccttaagtaaaaattcagtcatgagggaaacttttgttaaaatttgctttaaattaataggaagatcattaagaaaatcttaaaaagattgagtttttagatcgaaattattgaagaaaaattaacaggggttctgctcaaaattttattaaattactctactgtagtaaaggagaaattttatt

SEQ ID NO: 17 - DNA, 542 bp, Cyanobacterium sp. ABICyano1
gaatagttgataattactcgttactcattactcacttaaacctgccacctgatacctgccacctctccccccatcacctcatcccctcaacattccgaaccccttgacactttgaactaaaattgtattaaagtgcaaatctggacggggttaaccagtgtgacttataatagtaaacgctgttttttataataaataagctaaatatttaaaaactatgagtaaatatacactaaatggtactagacgtaagcagaaaagaacctccggtttccgcgcccgtatgagaaccaaaaatggtagaaaagtaattcaagctcgtcgtaataagggtagaaaaagattagcagtataaaattactgttaaataaggaagctaagtttagcattttaagtttgatattactaatcattaaatttactgtgaaatataggtgggactaccatcaaagcatcgactgaaacggcgtttaaatttccaatctgtttatcaacagggtattcgccgctctagtcgttattttattgtccgagggttacgg

SEQ ID NO: 18 - DNA, 380 bp, Cyanobacterium sp. ABICyano1
ataaccaatgggacttgaattttagatccatttatttaattctatttttgttacatttctttatattaatcagaattatgttactttgttttgttttatgtcgttaccttattgaagaaagagtggatgagaaggtaaatgacggggcataaatatcgattcgttgtcagaataagctgttttattcacttaactggttgtttgccaatttctccctaattcccataacttgtataactaaatttaataatcaattttagtaaattaagaataggttaaaagtagtatttagaattaagttaactttaataaatttcctgtatttttttatagaaaaaagtataaaataaaaacatatcaaaaaagtttgaaatgacaat

SEQ ID NO: 19 - DNA, 359 bp, Cyanobacterium sp. ABICyano1
cctcaactacaagttcttttatatattactttaacctgagttttggataagctgaaagcattattttctcgtagtcagaaaaccttatagcttcttagaaataacgataaaattaccttaatccgaactgacgttaaatatattcacccctatcaccccaaaaccctaagcccctacttccccctttcccttcatcacctcatccccccatcccctaacacttaaccttattctttattcttaaaccgaactgaggtgaagttgcagaatacccatggggggttacagcattgtagaaaaataaatattctttcattattaaggttgtttggtaaaaatatgtgaaaaccctaataatt

SEQ ID NO: 20 - DNA, 239 bp, Cyanobacterium sp. ABICyano1
ggggacagacatatttttatcataatggtaaattcataataattttagacttttttttgcaaaaattaatctcactctcttctttccctatctcccattgtttcttatatcccaatgccccaatacccaaagctcagaaaataggtattagcgaagaggtgttgatcccctcccctagcaaaatatactcctatatagtaaagtgagaaagtgaagaaataagatcaagttcgcaattt

SEQ ID NO: 21 - DNA, 496 bp, Cyanobacterium sp. ABICyano1
caaatcacgagaatttatgtagggactattttgggttgacggtggagagtatgtcgcccttgaattatgacccgaagatgaagatgtcggggaggtggaaggacggtctttaagaggtttaacatcaaagttggtcataatctctgtccctgtttgataactactatttaattttgagttgttttaggtacatcaaaatacccaaatccttactctcccctcaatatacaacaaaaaaaactttttgattcactttagtcataaaaattagaatttatctaccgaaatattacataaatgtaatgtatatattttctgatttattccgtgtgagccatgattcataatttataattcataatttctaaatatgcccctacaatggatatagaatgtcattttaattataggtatcataatcgtggtagttactccggaaaaaactattgaatcaaattcagtctcacctgctacagatagagtagccgttattctt

SEQ ID NO: 22 - DNA, 290 bp, Cyanobacterium sp. ABICyano1
ttgacgattgtattgacttacgccaaatggcttaccctcatagtgaatagttgataattaagaattaaaaatcccgttcacgacagaagggagtgtaagagccttcggtgcgaactctcatcttccctgaaacctgacacctgaaacctgacacctgaaacctgacacctcatctccctaatcccctaattttaatgaaaaaataccctgagtgggcattgaaaaaaaagaaaagttgttcgactatgaaataagaattctgcacttcgtgagaaaaaaggaaatgaaat

SEQ ID NO: 23 - DNA, 355 bp, Cyanobacterium sp. ABICyano1
ctatttaactaggaaaaggtaaagttaaaaggacaagggtaaataattaaaaattaagaattaagaacttctaactctcattactcattacttatttcctcctctcaccccttctcctgatcacctcttctcctcaatactcggaactcatttccccatggtgtgacactcaaatcaaaagtctgttattgactttcagatgaaatattactatgataacaatatcccccctatgggtatataaaaatatgagcgatattagttaaaaatcaaatttggattttttttctgaaaatattttaagattaagtaaagataagtaaagaaattataagcaattttgttaaatcatacc

SEQ ID NO: 24 - DNA, 619 bp, Cyanobacterium sp. ABICyano1
ctcacactgaaaatattgccacaagaaataaagatcaagcaataatcctgactaaaaaggaataaagtaattatccttttcctgatatgttatctgacttgttgtttcttagtcatgttccttccatttttatttttgtttttatcatttttattacaaaaatttcttaatagggctaaagcatttagttagttttttagctctcaacaagttgactaatcaatataatgccctaagttaatttgcccttggtttgacggaggatattggaaaaaagaaacttctcgttgtatttcacagggaaaagggggaaattttattaataactaaacaatagaaaataattatttatttatattattttgtgaacaaatgttcaagaattaaagtgtaataagaaaatttatttttttatatttatttaaaacttagatataagcctaaaggtctgaaattattattagacaatcaattgattcagaggtaatagttttttacttaaaaatattttttcaaaattatcccctatttgggtattgaaaaataaataaattcaagtaataatatacagaataaaggaaaatctaatcttaaaaattttgtgtgtgaggaattgaaa

SEQ ID NO: 25 - DNA, 190 bp, Cyanobacterium sp. ABICyano1
tatcaccattgtagaaaagccagaaaatcaattaacacaaatttcctgtaaattattatgtatgattttccccttctccccttaaaaggagaaataaaaaactatatcccccaaccaccgataagcattgtgagagaaaaatcatttaggtaggatcaatgctgtaaccgataaagataaataaataatt

SEQ ID NO: 26 - DNA, 536 bp, Cyanobacterium sp. ABICyano1
attctgtgaattgattagatttgaggttttttaagaggttgattaccttgcctccaaaaaaatcataacacactaatgctctatatgaaagggctttagacccataggtttttgagaaaaaaacttgctaactctcggacaatgtcagcataactaaagtcaattcttttcgtactttataattgtctataatttaatatacaactgttctgaaactagtttttctctacattccttagttttatctgagtaaggttgcttgtaacttaacttcggttgggcctaaaaatatccgattaggagcaggtgtcagactttaattaattattaattattaattgcttattgccaaccctcggcgacaccactttttcatcagccccagataaagattgatgttttagttttgtttctttttatcccctaattcaactaatacaagtaaaactaaggttgtttatcaaaaatgatggttgatgtttgggtaaattttaagatattatgaaaagaaaatgaataaaaaatgaaaaatcttt

SEQ ID NO: 27 - DNA, 283 bp, Cyanobacterium sp. ABICyano1
ctacaggggcaagatttggcggaaatctatatgtggattctctttcaagtgaagaaggtgcagtgccgacttatctggacttattagaatacgatattcgcactattactaatggtttgttagcaggagtgaacaattaaaaattttttcctaattgacgaataaaaaatcaatgtcaactaatagttaacaatactctctgaaaaccaaaaattgtcaaccaaaacataacataatttttacccaaaaacctcatttataaactttaaggataaaatcaatg

SEQ ID NO: 28 - DNA, 299 bp, Cyanobacterium sp. ABICyano1
gggattagagagttcaaagttaggaatgaggtgtcaggttttaggtttcaggtttaggggagcaatgagaaagaggtttcaggtttcaggtgtcaggttgcaggtgtcacaggtgatgaggggatgggggatgagggggaaacaagtaagtaataagtgttcggagtttttaattcttaattcttaatttttcctttgcctcttgccttttgccttgtcttaattactaatttctaattaaaatgattgtgttttctagtttagtctcatggttacttgaacccttacagcatagtttt

SEQ ID NO: 29 - DNA, 414 bp, Cyanobacterium sp. ABICyano1
ttacaaacggcgggaattattatggtagtagcgatgttagtaaccccgggtgcgatcgcatatttacttacagatcgttttgatcaaatgttaatcttatcaatagttagtagtgttctatcttgtgttttaggcacttatttaagttatcattttgatgtttctacggggggaagtattgtcgttttaatgaccataatttttattttagcgatgatttttgctcctaaatatggcatcatcaatcaaaataccaaaatatattctgcttaacttgtttactgatacttcaaataatcatataacctatcttccgagttaaaaataatggatattatccaactgaggtcgagaatagagtttcttttttgatagaatttttttacaccagttattcattactatcatgggata

SEQ ID NO: 30 - DNA, 412 bp, Cyanobacterium sp. ABICyano1
taatatagtgattattataaatgcaatgtgaatcaaacctatattttaccgtacattgaccatggaacttaatttgaggtgattagtagagggtgcgatcgccctatttgtcaaataataaagataacatttgacattgctgattgaagacataaaacacagaaaaaatcaggtaaaaatataaagctaaagtctaaatatggtttacttttgccttcgacttacaacaaaaaatcatagctagaatcaccaacgcctaatattttatttagctgaaattttgggatgaactttttgtaaaaatcgggggtctaaaaatatagcaaccacgatattaaataactgagtgattattttaatctattgggggcttattaactaaatacttgcatttttatggagggttttaatt

SEQ ID NO: 31 - DNA, 364 bp, Cyanobacterium sp. ABICyano1
aaagattattttctacagaagcaaccctttcatcttccgaattttcaggaatttcctgcttttgtttctgaatattagcataggcggcttttgcccactctaaagaaggttgagactgaatttctgaggtttcagaaggagcattagattgtttatcttcaacaacaggaggtttttgttcaatattttccttattctcttttttacggcgaaaccaattaaacataatgattgtgcataaatattcgttaatatattgtaaccctagaaaggaatcggtttcaggtttatccccagagaatgtgaacctttacagaaagtaaaaagtctaaaatcgtagcaacaataaatcacagaaattgag

SEQ ID NO: 32 - DNA, 234 bp, Cyanobacterium sp. ABICyano1
atctagtaataatcatcaagagttgttaaaacttcactatcaagaattggtagcaagaggattacaacatctgagtttagatcatcgagcagttattgttcttcatgatttggaagatttaccacaacaggaaatagcggaaatattatctattccccttggtacggtcaaatctcgtttattcaaagccagaaaaaatttgcgtcaatttttagaacttgaaggtattagctt

SEQ ID NO: 33 - DNA, 246 bp, Cyanobacterium sp. ABICyano1
ccaatatcttgtcatacatacttatttgcctcactattagccctatatgtctctattgtatttttctttttctcctattcctagatcttgtaatgaatcattactctctgaaatatagctactaattttatggttgtttgtaaaatatattaacaaatgaacaataaatcatattttgtgttaatctaattattagacaactactgaatttatattcagatattcacagataggagaattttgatt

SEQ ID NO: 34 - DNA, 346 bp, Cyanobacterium sp. ABICyano1
attctattaccctccgagggtggctatctccttttatttggtggctgataaaaccctattctattaaagtagccaatgagttagttaatgcggcggctaaatgtcactaaaatttcatcttaggttcacatcaaagtcatatcggttgtttatagtattaagtgtcagggagaaagataggttttcctctttagctccttcgcacctttaatccctgactttttttatttttttgttcgtgtgattaatctatttgtgtagcaattatttttatcttattttcttttcagtctagtaattaattatttttatattttgtattatttttagagaggtttgagctgtt

SEQ ID NO: 35 - DNA, 320 bp, Cyanobacterium sp. ABICyano1
gaatatctcatccttagcttctacttataccttcagcatagttaaaaatcatccctttattgatggtaataaaagaacaggttttattagtggagtaacctttttaatgctcaatggttctcactttactgcttctgaagtggaagtagtacatatcatccaaaccttagctagtggcagaattaccgaggaagaattacaacaatggttcgtaaggaaaagtaagcagatgaataattaaagcatcatttcatcctcatttcatattctcctgtcaccatggtatggaagattaggtaaaaatgaggaaaaagtttatt

SEQ ID NO: 36 - DNA, 304 bp, Cyanobacterium sp. ABICyano1
gcgattatcaaccacgaaaacatacaattattatcaaacctgctgagaaattatccacagaaatagatgtttctgcgaagggaaaatgggcttttcattgccatttaatgtatcacatggatgtgggaatgtttcggactattaatgttatttcctaaaaaataatagtattaaagcctaaaatttttataaaaaaattcatgtcttttattagggtgagcattcttcctttatgtctccttattttacctctttagaggtaactacaaacttaatcaaaaaatttagataattaattatatca

SEQ ID NO: 37 - DNA, 309 bp, Cyanobacterium sp. ABICyano1
atacatggttggttcactgacttttaccccagttttctctttgaacaattggcataactctgaaaaaatcagatcgggcttttgttgaattatttgttcaatcaaagcaaaaccgtgattgtctattttcttttttttcccaccactcatagataaaaatttatcccgaactcaggttatattaagttcggatgatcacttaagataattgatcagattggttaagatagagaaaaattctttttcatagtgatttcataattgatagttacaataacgattattatttagtaaaaagattttcaaatc

SEQ ID NO: 38 - DNA, 330 bp, Cyanobacterium sp. ABICyano1
tggtcaagttactatatgtttagaaacaacaaaaaaagaagtcattataaaaataattgatacaggaattggcattaataaagaagaacaaaaattaatttttaatcgtttttatcgaatcaataaagcaagaaatagagagaaaggcagttgcggattaggtttagctattgcaaatgcgatcgcgcttaatcatggtggtagaataattttagaaagtcaagaaaatcaaggcagtatttttaccgtttatttaccgaaaatcatttcatcctaatttcatattcttttgacagaatcaaaggtaaagataaaaagagagaaacagtc

SEQ ID NO: 39 - DNA, 490 bp, Cyanobacterium sp. ABICyano1
catctttacttttgactaacatttcataggtatcatgacgaaaattttttagtctgttatatttgttcatgtagagagattttaatttgtgattattttattttctctctatttttcttttttgtcttgtccttcctcatttttctctacatttagtctaaactacagctctttaatcttcagtttctctttcctcctcttcctcatcaaggtaatcatcccaattaatatcttcttcttgttctaatttgggttgagattgttgtttatcaatcatatttcatactcctaaaactttcttacttatttatcagttactttttacccatttatgcaatagtgtagaaatttttttcgatcgagttaattaatttttatttcaaccatatctaaataattcttgatggacattctagttaactagaaggtttaagctaaaaataattattgatattgccttcggtataactaactatatccagagaaaaag

SEQ ID NO: 40 - DNA, 433 bp, Cyanobacterium sp. ABICyano1
tttatatataaactcgaataaaattatcaatataaagtcaaactatatctatcctattttaactgctattggtaagtcccttaattagtgttggggtgaatagattttaaaagggcaaacccccctttatcctccctcgagaggggggagggcaaaaggcaaggggcaagggaaaaattaagaattaagaattaaaaactccgaacacctgtaggggcgaatagccattcgcttcccctcatccccccatctccccaacaccctaagcccctactcgttactcatttatttacatcatttatttacatcattaagaaaagtaacaaattttgacaagtagtcttttgacaggaaaaagcaaattctcgaagatgaaaacaatagaaaaaaattcaatcttacagtaacgatgaaaaaacttttaggcttaatt

SEQ ID NO: 41 - DNA, 306 bp, Cyanobacterium sp. ABICyano1
ctcaagagatagttaaaaaacaaatagctttagtctatcaattaatcgaattatttttacaaacaaattttcataaacccatagaactagaggaggaagttatttatgtttaaaaatctaaaagagttttatattcccctaaaacccccttagtaagagtgacttttttcatcatttgcctgtaaattctcctcttttaataagagagctagggtgttttaaaagaggattttattgctttccaattctaactacttcaaaaacttattttatactcaataatttattaatcaagaggaaattacc

SEQ ID NO: 42 - DNA, 12968 bp, Cyanobacterium sp. ABICyano1
aatatttttcgtcagatacgcaaaccttacaaacataattaacaactgaaactattgatatgtctaggttttagctctatcacaggttggatctgtcgacaattaataacttcttcctgtacgggcgaatggccatttgctcctaactaactccgtactgctttgcggaacgagcgtagcgaactctccgaattactaagccttcatccctgatagatgcaaaaaacgaattaaaattatgtgtaaaaagaaaatgtgtctttatttagtagtcaaagttacaaaatattaagaatcaaattaataatgtattgggcagttaagtatataagtctttaaatatttatttgtattcaatatattaaccgaggacaaattatgaattcttataccgtgggtacttatttagccgaacgcttagtgcaaattggtttaaaacatcattttgccgtggctggggactataatttagtgttattggataacttattattaaataaaaacatggaacaagtgtattgttgtaatgaattaaattgtggtttttctgctgaaggttatgctagagctaaaggtgcagctgctgctgttgttacttattctgtgggtgctttatctgcttttgatgctattggtggtgcttatgccgaaaatttacccgtgattttaatttctggtgcccctaataataatgatcatgccgctggacatgttttacatcatgccttaggtaaaaccgattatcattatcaattagaaatggccaaaaatattactgctgctgccgaagctatttatactcctgaagaagcccctgccaaaattgatcatgtgattaaaaccgccttacgcgaaaaaaaacccgtgtatttagaaattgcctgtaatattgcttctatgccttgtgctgctcctgggcctgcttctgctttatttaatgatgaagcctctgatgaagctagtttaaatgctgccgtggaagaaaccttaaaatttattgccaatcgcgataaagttgccgtgttagttggttctaaattaagagctgctggtgctgaagaagctgctgttaaatttgctgatgctttaggtggtgcagttgctactatggctgctgccaaatctttttttcccgaagaaaatccccattatattggaactagttggggagaagtttcttatcctggtgtggaaaaaactatgaaagaagccgacgctgttattgctttagcccctgtgtttaatgattattctaccactggttggactgatattcccgatcccaaaaaattagttttagccgaacctcgttctgttgttgttaatggtgttcgctttccctctgtgcatttaaaagattatttaacccgcttagcccaaaaagtttctaaaaaaactggtgccttagatttttttaaatctttaaatgcgggtgaattaaaaaaagctgctcctgctgatccttctgctcctttagttaatgctgaaattgcccgtcaagttgaagccttattaacccctaatactaccgttattgccgaaactggtgattcttggtttaatgcccaacgcatgaaattacctaatggtgcccgtgttgaatatgaaatgcaatggggtcatattggttggtctgtacctgctgcttttggttatgctgttggtgctcctgaacgtcgtaatattttaatggtgggtgatggttcttttcaattaactgcccaagaagttgcccaaatggttcgcttaaaattacccgttattatttttttaataaataattatggttataccattgaagtgatgattcatgatgggccatataataatattaaaaattgggattatgcgggtttaatggaagtgtttaatggtaatggtggttatgattctggtgctggtaaaggtttaaaagccaaaactggtggtgaattagctgaagctattaaagttgccttagccaatactgatgggccaaccttaattgaatgttttattggtcgcgaagattgtaccgaagaattagttaaatggggtaaacgtgttgctgctgctaattctcgcaaacccgtgaataaattattgtaatttttggggatcaattcgagctcggtacccaaactagtatgtagggtgaggttatagctagcgcttttaattaatccgcggatttgtattcaatatattaaccgaggacaacatatgattaaagcctatgctgccttagaagccaatggtaaattacaaccctttgaatatgatcctggtgctttaggtgccaatgaagtggaaattgaagtgcaatattgtggtgtgtgtcattctgatttatctatgattaataatgaatggggtatttctaattatcccttagttcctggtcatgaagttgttggtactgttgctgctatgggtgaaggtgttaatcatgtggaagtgggtgatttagttggtttaggttggcattctggttattgtatgacctgtcattcttgtttatctggttatcataatttatgtgccactgccgaatctactattgtgggtcattatggtggttttggtgatagagttcgtgctaaaggtgtttctgtggtgaaattacccaaaggtattgatttagcctctgctgggcctttattttgtggtggtattaccgttttttctcccatggtggaattatctttaaaacctaccgccaaagttgctgttattggtattggtggtttaggtcatttagccgttcaatttttaagagcctggggttgtgaagttactgcttttacctcttctgcccgtaaacaaaccgaagttttagaattaggtgcccatcatattttagattctaccaatcctgaagctattgcttctgccgaaggtaaatttgattatattatttctaccgtgaatttaaaattagattggaatttatatatcagtaccttagcccctcaaggtcattttcattttgttggtgtggtgttagaacccttggacttaaacttatttcccttattaatgggacaacgttctgtttctgcttctcctgttggttctcctgctactattgccactatgttagattttgccgtgcgtcatgatattaaacccgtggtggaacaattttcttttgatcaaattaatgaagccattgcccatttagaatctggtaaagcccattatcgcgtggtgttatctcattctaaaaattaataagattaacttctaaactgaaacaaatttgagggtaggcttcattgtctgcccttatttttttatttaggaaaagtgaacagactaaagagtgttggctctattgctttgagtatgtaaattaggcgttgctgaattaaggtatgatttttgaccccttctctcttctgcagttacctaggatttctggcgaaagggggatgtgctgcaaggcgattaagttgggtaacgccagggttttcccagtcacgacgttgtaaaacgacggccagtgagcgcgacgtaatacgactcactatagggcgaattggcggaaggccgtcaaggccgcatggcgcgcctacgtagacaattgtcgatgtaattattaactatcttattatagatgaggggagagggagaaattagttcggagagaacgctcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgtcctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttg

SEQ ID NO: 43 - DNA, 13449 bp, Cyanobacterium sp. ABICyano1
aatatttttcgtcagatacgcaaaccttacaaacataattaacaactgaaactattgatatgtctaggttttagctctatcacaggttggatctgtcgacaattaataacttcttcctgtacgggcgaatggccatttgctcctaactaactccgtactgctttgcggaacgagcgtagcgaactctccgaattactaagccttcatccctgatagatgcaaaaaacgaattaaaattatgtgtaaaaagaaaatgtgtctttatttagtagtcaaagttacaaaatattaagaatcaaattaataatgtattgggcagttaagtatataagtctttaaatatttatttgtattcaatatattaaccgaggacaaattatgaattcttataccgtgggtacttatttagccgaacgcttagtgcaaattggtttaaaacatcattttgccgtggctggggactataatttagtgttattggataacttattattaaataaaaacatggaacaagtgtattgttgtaatgaattaaattgtggtttttctgctgaaggttatgctagagctaaaggtgcagctgctgctgttgttacttattctgtgggtgctttatctgcttttgatgctattggtggtgcttatgccgaaaatttacccgtgattttaatttctggtgcccctaataataatgatcatgccgctggacatgttttacatcatgccttaggtaaaaccgattatcattatcaattagaaatggccaaaaatattactgctgctgccgaagctatttatactcctgaagaagcccctgccaaaattgatcatgtgattaaaaccgccttacgcgaaaaaaaacccgtgtatttagaaattgcctgtaatattgcttctatgccttgtgctgctcctgggcctgcttctgctttatttaatgatgaagcctctgatgaagctagtttaaatgctgccgtggaagaaaccttaaaatttattgccaatcgcgataaagttgccgtgttagttggttctaaattaagagctgctggtgctgaagaagctgctgttaaatttgctgatgctttaggtggtgcagttgctactatggctgctgccaaatctttttttcccgaagaaaatccccattatattggaactagttggggagaagtttcttatcctggtgtggaaaaaactatgaaagaagccgacgctgttattgctttagcccctgtgtttaatgattattctaccactggttggactgatattcccgatcccaaaaaattagttttagccgaacctcgttctgttgttgttaatggtgttcgctttccctctgtgcatttaaaagattatttaacccgcttagcccaaaaagtttctaaaaaaactggtgccttagatttttttaaatctttaaatgcgggtgaattaaaaaaagctgctcctgctgatccttctgctcctttagttaatgctgaaattgcccgtcaagttgaagccttattaacccctaatactaccgttattgccgaaactggtgattcttggtttaatgcccaacgcatgaaattacctaatggtgcccgtgttgaatatgaaatgcaatggggtcatattggttggtctgtacctgctgcttttggttatgctgttggtgctcctgaacgtcgtaatattttaatggtgggtgatggttcttttcaattaactgcccaagaagttgcccaaatggttcgcttaaaattacccgttattatttttttaataaataattatggttataccattgaagtgatgattcatgatgggccatataataatattaaaaattgggattatgcgggtttaatggaagtgtttaatggtaatggtggttatgattctggtgctggtaaaggtttaaaagccaaaactggtggtgaattagctgaagctattaaagttgccttagccaatactgatgggccaaccttaattgaatgttttattggtcgcgaagattgtaccgaagaattagttaaatggggtaaacgtgttgctgctgctaattctcgcaaacccgtgaataaattattgtaatttttggggatcaattcgagctcctccgcttaaaaaatttcatttttcgatcaaaaaagacaaattattactaattagctcatggcaataaataatcagtagtaatctgttttcacattttattgttaatttttattattgctaatatcaaccttttctacttctgcttaatattttatttatgctcaatgggaaaatctgaaataagattgagaacagtgttaccaatagaagtatttaaggtttaaagcataccttaaagataacatttttttttgaaaagagtcaaattatttttgaaaggctgatatttttgatatttactaatattttatttatttctttttcccttaaaataagagctaaatctgtttttattatcatttatcaagctctattaatacctcaactttttcaagaaaaaataataataatttttccctctattctcatgaccttttaggaaaattaattttagaaaaactattgacaaacccataaaaaatgagataagattatagattgtcactggtattttatactagaggcaaattatatttatatatacaaaaatgctgtataaaaaacatctcatatgattaaagcctatgctgccttagaagccaatggtaaattacaaccctttgaatatgatcctggtgctttaggtgccaatgaagtggaaattgaagtgcaatattgtggtgtgtgtcattctgatttatctatgattaataatgaatggggtatttctaattatcccttagttcctggtcatgaagttgttggtactgttgctgctatgggtgaaggtgttaatcatgtggaagtgggtgatttagttggtttaggttggcattctggttattgtatgacctgtcattcttgtttatctggttatcataatttatgtgccactgccgaatctactattgtgggtcattatggtggttttggtgatagagttcgtgctaaaggtgtttctgtggtgaaattacccaaaggtattgatttagcctctgctgggcctttattttgtggtggtattaccgttttttctcccatggtggaattatctttaaaacctaccgccaaagttgctgttattggtattggtggtttaggtcatttagccgttcaatttttaagagcctggggttgtgaagttactgcttttacctcttctgcccgtaaacaaaccgaagttttagaattaggtgcccatcatattttagattctaccaatcctgaagctattgcttctgccgaaggtaaatttgattatattatttctaccgtgaatttaaaattagattggaatttatatatcagtaccttagcccctcaaggtcattttcattttgttggtgtggtgttagaacccttggacttaaacttatttcccttattaatgggacaacgttctgtttctgcttctcctgttggttctcctgctactattgccactatgttagattttgccgtgcgtcatgatattaaacccgtggtggaacaattttcttttgatcaaattaatgaagccattgcccatttagaatctggtaaagcccattatcgcgtggtgttatctcattctaaaaattaataagattaacttctaaactgaaacaaatttgagggtaggcttcattgtctgcccttatttttttatttaggaaaagtgaacagactaaagagtgttggctctattgctttgagtatgtaaattaggcgttgctgaattaaggtatgatttttgaccccttctctcttctgcagttacctaggatttctggcgaaagggggatgtgctgcaaggcgattaagttgggtaacgccagggttttcccagtcacgacgttgtaaaacgacggccagtgagcgcgacgtaatacgactcactatagggcgaattggcggaaggccgtcaaggccgcatggcgcgcctacgtagacaattgtcgatgtaattattaactatcttattatagatgaggggagagggagaaattagttcggagagaacgctcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgtcctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttg

SEQ ID NO: 44 - DNA, 13033 bp, Cyanobacterium sp. ABICyano1
aatatttttcgtcagatacgcaaaccttacaaacataattaacaactgaaactattgatatgtctaggttttagctctatcacaggttggatctgtcgacaattaataacttcttcctgtacgggcgaatggccatttgctcctaactaactccgtactgctttgcggaacgagcgtagcgaactctccgaattactaagccttcatccctgatagatgcaaaaaacgaattaaaattatgtgtaaaaagaaaatgtgtctttatttagtagtcaaagttacaaaatattaagaatcaaattaataatgtattgggcagttaagtatataagtctttaaatatttatttgtattcaatatattaaccgaggacaaattatgaattcttataccgtgggtacttatttagccgaacgcttagtgcaaattggtttaaaacatcattttgccgtggctggggactataatttagtgttattggataacttattattaaataaaaacatggaacaagtgtattgttgtaatgaattaaattgtggtttttctgctgaaggttatgctagagctaaaggtgcagctgctgctgttgttacttattctgtgggtgctttatctgcttttgatgctattggtggtgcttatgccgaaaatttacccgtgattttaatttctggtgcccctaataataatgatcatgccgctggacatgttttacatcatgccttaggtaaaaccgattatcattatcaattagaaatggccaaaaatattactgctgctgccgaagctatttatactcctgaagaagcccctgccaaaattgatcatgtgattaaaaccgccttacgcgaaaaaaaacccgtgtatttagaaattgcctgtaatattgcttctatgccttgtgctgctcctgggcctgcttctgctttatttaatgatgaagcctctgatgaagctagtttaaatgctgccgtggaagaaaccttaaaatttattgccaatcgcgataaagttgccgtgttagttggttctaaattaagagctgctggtgctgaagaagctgctgttaaatttgctgatgctttaggtggtgcagttgctactatggctgctgccaaatctttttttcccgaagaaaatccccattatattggaactagttggggagaagtttcttatcctggtgtggaaaaaactatgaaagaagccgacgctgttattgctttagcccctgtgtttaatgattattctaccactggttggactgatattcccgatcccaaaaaattagttttagccgaacctcgttctgttgttgttaatggtgttcgctttccctctgtgcatttaaaagattatttaacccgcttagcccaaaaagtttctaaaaaaactggtgccttagatttttttaaatctttaaatgcgggtgaattaaaaaaagctgctcctgctgatccttctgctcctttagttaatgctgaaattgcccgtcaagttgaagccttattaacccctaatactaccgttattgccgaaactggtgattcttggtttaatgcccaacgcatgaaattacctaatggtgcccgtgttgaatatgaaatgcaatggggtcatattggttggtctgtacctgctgcttttggttatgctgttggtgctcctgaacgtcgtaatattttaatggtgggtgatggttcttttcaattaactgcccaagaagttgcccaaatggttcgcttaaaattacccgttattatttttttaataaataattatggttataccattgaagtgatgattcatgatgggccatataataatattaaaaattgggattatgcgggtttaatggaagtgtttaatggtaatggtggttatgattctggtgctggtaaaggtttaaaagccaaaactggtggtgaattagctgaagctattaaagttgccttagccaatactgatgggccaaccttaattgaatgttttattggtcgcgaagattgtaccgaagaattagttaaatggggtaaacgtgttgctgctgctaattctcgcaaacccgtgaataaattattgtaatttttggggatcaattcgagctcgccttactataaacaaaagttatctgagaaataactataactattctgaaaatatttgacaaaactttacaattttgttatattagtaagtgaggtgagcaaatcacccaaaatatataagtacctcgaaaaattcataactgaaatcataagcatatgattaaagcctatgctgccttagaagccaatggtaaattacaaccctttgaatatgatcctggtgctttaggtgccaatgaagtggaaattgaagtgcaatattgtggtgtgtgtcattctgatttatctatgattaataatgaatggggtatttctaattatcccttagttcctggtcatgaagttgttggtactgttgctgctatgggtgaaggtgttaatcatgtggaagtgggtgatttagttggtttaggttggcattctggttattgtatgacctgtcattcttgtttatctggttatcataatttatgtgccactgccgaatctactattgtgggtcattatggtggttttggtgatagagttcgtgctaaaggtgtttctgtggtgaaattacccaaaggtattgatttagcctctgctgggcctttattttgtggtggtattaccgttttttctcccatggtggaattatctttaaaacctaccgccaaagttgctgttattggtattggtggtttaggtcatttagccgttcaatttttaagagcctggggttgtgaagttactgcttttacctcttctgcccgtaaacaaaccgaagttttagaattaggtgcccatcatattttagattctaccaatcctgaagctattgcttctgccgaaggtaaatttgattatattatttctaccgtgaatttaaaattagattggaatttatatatcagtaccttagcccctcaaggtcattttcattttgttggtgtggtgttagaacccttggacttaaacttatttcccttattaatgggacaacgttctgtttctgcttctcctgttggttctcctgctactattgccactatgttagattttgccgtgcgtcatgatattaaacccgtggtggaacaattttcttttgatcaaattaatgaagccattgcccatttagaatctggtaaagcccattatcgcgtggtgttatctcattctaaaaattaataagattaacttctaaactgaaacaaatttgagggtaggcttcattgtctgcccttatttttttatttaggaaaagtgaacagactaaagagtgttggctctattgctttgagtatgtaaattaggcgttgctgaattaaggtatgatttttgaccccttctctcttctgcagttacctaggatttctggcgaaagggggatgtgctgcaaggcgattaagttgggtaacgccagggttttcccagtcacgacgttgtaaaacgacggccagtgagcgcgacgtaatacgactcactatagggcgaattggcggaaggccgtcaaggccgcatggcgcgcctacgtagacaattgtcgatgtaattattaactatcttattatagatgaggggagagggagaaattagttcggagagaacgctcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgtcctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttg

SEQ ID NO: 45 - DNA, 13081 bp, Cyanobacterium sp. ABICyano1
aatatttttcgtcagatacgcaaaccttacaaacataattaacaactgaaactattgatatgtctaggttttagctctatcacaggttggatctgtcgacgagaaggggaacagggaaaagtatttataattgatacaaactgtggttcaacttattttaaagacatttttctccatttaatgattatttcggggaaaattttgaggatttttgattcttaaattgacgatattttgtcactaacacaacgtgagcggtaaatttatatatagacctaaaacctttactataagtgttatatatttaaatcgctaagtatatagttaaagtgtagccaataattaacttttaacaagtgattaccgttaagtcccttaatttatcactacaagctaaaacaaatttttcaattagatatgacattaggtcaaagttcatagtatgatagtaaaaaataaaatttgacgatctgtaaaaataaaaaaacacaatgaattcttataccgtgggtacttatttagccgaacgcttagtgcaaattggtttaaaacatcattttgccgtggctggggactataatttagtgttattggataacttattattaaataaaaacatggaacaagtgtattgttgtaatgaattaaattgtggtttttctgctgaaggttatgctagagctaaaggtgcagctgctgctgttgttacttattctgtgggtgctttatctgcttttgatgctattggtggtgcttatgccgaaaatttacccgtgattttaatttctggtgcccctaataataatgatcatgccgctggacatgttttacatcatgccttaggtaaaaccgattatcattatcaattagaaatggccaaaaatattactgctgctgccgaagctatttatactcctgaagaagcccctgccaaaattgatcatgtgattaaaaccgccttacgcgaaaaaaaacccgtgtatttagaaattgcctgtaatattgcttctatgccttgtgctgctcctgggcctgcttctgctttatttaatgatgaagcctctgatgaagctagtttaaatgctgccgtggaagaaaccttaaaatttattgccaatcgcgataaagttgccgtgttagttggttctaaattaagagctgctggtgctgaagaagctgctgttaaatttgctgatgctttaggtggtgcagttgctactatggctgctgccaaatctttttttcccgaagaaaatccccattatattggaactagttggggagaagtttcttatcctggtgtggaaaaaactatgaaagaagccgacgctgttattgctttagcccctgtgtttaatgattattctaccactggttggactgatattcccgatcccaaaaaattagttttagccgaacctcgttctgttgttgttaatggtgttcgctttccctctgtgcatttaaaagattatttaacccgcttagcccaaaaagtttctaaaaaaactggtgccttagatttttttaaatctttaaatgcgggtgaattaaaaaaagctgctcctgctgatccttctgctcctttagttaatgctgaaattgcccgtcaagttgaagccttattaacccctaatactaccgttattgccgaaactggtgattcttggtttaatgcccaacgcatgaaattacctaatggtgcccgtgttgaatatgaaatgcaatggggtcatattggttggtctgtacctgctgcttttggttatgctgttggtgctcctgaacgtcgtaatattttaatggtgggtgatggttcttttcaattaactgcccaagaagttgcccaaatggttcgcttaaaattacccgttattatttttttaataaataattatggttataccattgaagtgatgattcatgatgggccatataataatattaaaaattgggattatgcgggtttaatggaagtgtttaatggtaatggtggttatgattctggtgctggtaaaggtttaaaagccaaaactggtggtgaattagctgaagctattaaagttgccttagccaatactgatgggccaaccttaattgaatgttttattggtcgcgaagattgtaccgaagaattagttaaatggggtaaacgtgttgctgctgctaattctcgcaaacccgtgaataaattattgtaatttttggggatcaattcgagctcggtacccaaactagtatgtagggtgaggttatagctagcgcttttaattaatccgcggatttgtattcaatatattaaccgaggacaacatatgattaaagcctatgctgccttagaagccaatggtaaattacaaccctttgaatatgatcctggtgctttaggtgccaatgaagtggaaattgaagtgcaatattgtggtgtgtgtcattctgatttatctatgattaataatgaatggggtatttctaattatcccttagttcctggtcatgaagttgttggtactgttgctgctatgggtgaaggtgttaatcatgtggaagtgggtgatttagttggtttaggttggcattctggttattgtatgacctgtcattcttgtttatctggttatcataatttatgtgccactgccgaatctactattgtgggtcattatggtggttttggtgatagagttcgtgctaaaggtgtttctgtggtgaaattacccaaaggtattgatttagcctctgctgggcctttattttgtggtggtattaccgttttttctcccatggtggaattatctttaaaacctaccgccaaagttgctgttattggtattggtggtttaggtcatttagccgttcaatttttaagagcctggggttgtgaagttactgcttttacctcttctgcccgtaaacaaaccgaagttttagaattaggtgcccatcatattttagattctaccaatcctgaagctattgcttctgccgaaggtaaatttgattatattatttctaccgtgaatttaaaattagattggaatttatatatcagtaccttagcccctcaaggtcattttcattttgttggtgtggtgttagaacccttggacttaaacttatttcccttattaatgggacaacgttctgtttctgcttctcctgttggttctcctgctactattgccactatgttagattttgccgtgcgtcatgatattaaacccgtggtggaacaattttcttttgatcaaattaatgaagccattgcccatttagaatctggtaaagcccattatcgcgtggtgttatctcattctaaaaattaataagattaacttctaaactgaaacaaatttgagggtaggcttcattgtctgcccttatttttttatttaggaaaagtgaacagactaaagagtgttggctctattgctttgagtatgtaaattaggcgttgctgaattaaggtatgatttttgaccccttctctcttctgcagttacctaggatttctggcgaaagggggatgtgctgcaaggcgattaagttgggtaacgccagggttttcccagtcacgacgttgtaaaacgacggccagtgagcgcgacgtaatacgactcactatagggcgaattggcggaaggccgtcaaggccgcatggcgcgcctacgtagacaattgtcgatgtaattattaactatcttattatagatgaggggagagggagaaattagttcggagagaacgctcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgtcctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttg

SEQ ID NO: 46 - DNA, 13562 bp, Cyanobacterium sp. ABICyano1
aatatttttcgtcagatacgcaaaccttacaaacataattaacaactgaaactattgatatgtctaggttttagctctatcacaggttggatctgtcgacgagaaggggaacagggaaaagtatttataattgatacaaactgtggttcaacttattttaaagacatttttctccatttaatgattatttcggggaaaattttgaggatttttgattcttaaattgacgatattttgtcactaacacaacgtgagcggtaaatttatatatagacctaaaacctttactataagtgttatatatttaaatcgctaagtatatagttaaagtgtagccaataattaacttttaacaagtgattaccgttaagtcccttaatttatcactacaagctaaaacaaatttttcaattagatatgacattaggtcaaagttcatagtatgatagtaaaaaataaaatttgacgatctgtaaaaataaaaaaacacaatgaattcttataccgtgggtacttatttagccgaacgcttagtgcaaattggtttaaaacatcattttgccgtggctggggactataatttagtgttattggataacttattattaaataaaaacatggaacaagtgtattgttgtaatgaattaaattgtggtttttctgctgaaggttatgctagagctaaaggtgcagctgctgctgttgttacttattctgtgggtgctttatctgcttttgatgctattggtggtgcttatgccgaaaatttacccgtgattttaatttctggtgcccctaataataatgatcatgccgctggacatgttttacatcatgccttaggtaaaaccgattatcattatcaattagaaatggccaaaaatattactgctgctgccgaagctatttatactcctgaagaagcccctgccaaaattgatcatgtgattaaaaccgccttacgcgaaaaaaaacccgtgtatttagaaattgcctgtaatattgcttctatgccttgtgctgctcctgggcctgcttctgctttatttaatgatgaagcctctgatgaagctagtttaaatgctgccgtggaagaaaccttaaaatttattgccaatcgcgataaagttgccgtgttagttggttctaaattaagagctgctggtgctgaagaagctgctgttaaatttgctgatgctttaggtggtgcagttgctactatggctgctgccaaatctttttttcccgaagaaaatccccattatattggaactagttggggagaagtttcttatcctggtgtggaaaaaactatgaaagaagccgacgctgttattgctttagcccctgtgtttaatgattattctaccactggttggactgatattcccgatcccaaaaaattagttttagccgaacctcgttctgttgttgttaatggtgttcgctttccctctgtgcatttaaaagattatttaacccgcttagcccaaaaagtttctaaaaaaactggtgccttagatttttttaaatctttaaatgcgggtgaattaaaaaaagctgctcctgctgatccttctgctcctttagttaatgctgaaattgcccgtcaagttgaagccttattaacccctaatactaccgttattgccgaaactggtgattcttggtttaatgcccaacgcatgaaattacctaatggtgcccgtgttgaatatgaaatgcaatggggtcatattggttggtctgtacctgctgcttttggttatgctgttggtgctcctgaacgtcgtaatattttaatggtgggtgatggttcttttcaattaactgcccaagaagttgcccaaatggttcgcttaaaattacccgttattatttttttaataaataattatggttataccattgaagtgatgattcatgatgggccatataataatattaaaaattgggattatgcgggtttaatggaagtgtttaatggtaatggtggttatgattctggtgctggtaaaggtttaaaagccaaaactggtggtgaattagctgaagctattaaagttgccttagccaatactgatgggccaaccttaattgaatgttttattggtcgcgaagattgtaccgaagaattagttaaatggggtaaacgtgttgctgctgctaattctcgcaaacccgtgaataaattattgtaatttttggggatcaattcgagctcctccgcttaaaaaatttcatttttcgatcaaaaaagacaaattattactaattagctcatggcaataaataatcagtagtaatctgttttcacattttattgttaatttttattattgctaatatcaaccttttctacttctgcttaatattttatttatgctcaatgggaaaatctgaaataagattgagaacagtgttaccaatagaagtatttaaggtttaaagcataccttaaagataacatttttttttgaaaagagtcaaattatttttgaaaggctgatatttttgatatttactaatattttatttatttctttttcccttaaaataagagctaaatctgtttttattatcatttatcaagctctattaatacctcaactttttcaagaaaaaataataataatttttccctctattctcatgaccttttaggaaaattaattttagaaaaactattgacaaacccataaaaaatgagataagattatagattgtcactggtattttatactagaggcaaattatatttatatatacaaaaatgctgtataaaaaacatctcatatgattaaagcctatgctgccttagaagccaatggtaaattacaaccctttgaatatgatcctggtgctttaggtgccaatgaagtggaaattgaagtgcaatattgtggtgtgtgtcattctgatttatctatgattaataatgaatggggtatttctaattatcccttagttcctggtcatgaagttgttggtactgttgctgctatgggtgaaggtgttaatcatgtggaagtgggtgatttagttggtttaggttggcattctggttattgtatgacctgtcattcttgtttatctggttatcataatttatgtgccactgccgaatctactattgtgggtcattatggtggttttggtgatagagttcgtgctaaaggtgtttctgtggtgaaattacccaaaggtattgatttagcctctgctgggcctttattttgtggtggtattaccgttttttctcccatggtggaattatctttaaaacctaccgccaaagttgctgttattggtattggtggtttaggtcatttagccgttcaatttttaagagcctggggttgtgaagttactgcttttacctcttctgcccgtaaacaaaccgaagttttagaattaggtgcccatcatattttagattctaccaatcctgaagctattgcttctgccgaaggtaaatttgattatattatttctaccgtgaatttaaaattagattggaatttatatatcagtaccttagcccctcaaggtcattttcattttgttggtgtggtgttagaacccttggacttaaacttatttcccttattaatgggacaacgttctgtttctgcttctcctgttggttctcctgctactattgccactatgttagattttgccgtgcgtcatgatattaaacccgtggtggaacaattttcttttgatcaaattaatgaagccattgcccatttagaatctggtaaagcccattatcgcgtggtgttatctcattctaaaaattaataagattaacttctaaactgaaacaaatttgagggtaggcttcattgtctgcccttatttttttatttaggaaaagtgaacagactaaagagtgttggctctattgctttgagtatgtaaattaggcgttgctgaattaaggtatgatttttgaccccttctctcttctgcagttacctaggatttctggcgaaagggggatgtgctgcaaggcgattaagttgggtaacgccagggttttcccagtcacgacgttgtaaaacgacggccagtgagcgcgacgtaatacgactcactatagggcgaattggcggaaggccgtcaaggccgcatggcgcgcctacgtagacaattgtcgatgtaattattaactatcttattatagatgaggggagagggagaaattagttcggagagaacgctcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgtcctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttg

SEQ ID NO: 47 - DNA, 13119 bp, Cyanobacterium sp. ABICyano1
tcgacaattaataacttcttcctgtacgggcgaatggccatttgctcctaactaactccgtactgctttgcggaacgagcgtagcgaactctccgaattactaagccttcatccctgatagatgcaaaaaacgaattaaaattatgtgtaaaaagaaaatgtgtctttatttagtagtcaaagttacaaaatattaagaatcaaattaataatgtattgggcagttaagtatataagtctttaaatatttatttgtattcaatatattaaccgaggacaaattatgaattcttacactgttggaacctatttagcagaacgtttagttcaaattggtctcaaacaccattttgcagtagctggtgattataatttagttttattggataacttattgttaaataagaatatggaacaagtgtattgttgtaatgaattaaactgtggtttttctgctgagggatatgctcgtgcaaaaggtgctgccgcagcagttgttacttattctgttggagcattaagtgcttttgacgctattggaggtgcttatgcagaaaatttacctgtaatcttaatctctggtgcacccaataacaacgatcacgctgctggtcatgtattgcatcatgctttaggtaaaaccgattatcattaccaattagaaatggcaaaaaatattaccgctgccgcagaagctatttatactcccgaagaagcacctgctaagatcgatcacgtaattaaaaccgctctccgtgagaaaaaacccgtatatttagaaatcgcttgcaatatcgcttctatgccttgtgcagctcctggacctgctagtgctttatttaacgatgaagcatctgatgaggctagtttaaatgccgctgttgaagaaactttgaaatttattgctaatcgtgataaagtagctgttttagttggttctaaactccgtgccgctggtgcagaagaagcggctgtaaaattcgcagatgccttaggaggtgctgttgccacaatggcagccgctaaaagttttttccccgaagaaaatcctcattacattggtacttcttggggtgaggtatcttaccctggtgtagaaaaaaccatgaaggaagctgatgcagtaattgcattagctcctgttttcaatgattactctaccactggttggactgatattccagaccccaaaaaattagttttagcagaacctcgctctgtagttgtgaatggtgttagatttcccagtgtacatctcaaagattatttaactcgtttagctcaaaaagtgagtaaaaagactggcgcactcgatttctttaaatctttaaatgctggtgaattaaagaaagcagctcctgctgatcccagtgctcctttagtgaatgccgaaatcgcaagacaagttgaagccttgttaactcctaacactaccgttattgccgagactggtgatagttggttcaatgctcaacgcatgaaattacccaatggtgctcgtgttgagtatgaaatgcaatggggtcacattggatggtctgttcctgctgcatttggatatgcagttggagcacctgagcgtagaaacattttaatggtaggtgatggttctttccaactcactgctcaagaagttgcacaaatggtacgtttaaaattgcctgttattatctttctcattaacaactatggttacaccattgaagttatgattcatgatggtccttataataacattaagaattgggattacgcaggtttaatggaggtatttaacggtaatggtggatacgacagtggagcaggtaaaggattaaaagctaaaacaggaggtgagttagctgaagcaattaaagtagctttagccaatacagatggtcctaccttaatcgaatgtttcattggacgtgaagattgtactgaagagttagttaaatggggaaagcgtgttgccgctgcaaattctcgtaaacctgtaaacaaactcttgtagttaggatccgagctcctccgcttaaaaaatttcatttttcgatcaaaaaagacaaattattactaattagctcatggcaataaataatcagtagtaatctgttttcacattttattgttaatttttattattgctaatatcaaccttttctacttctgcttaatattttatttatgctcaatgggaaaatctgaaataagattgagaacagtgttaccaatagaagtatttaaggtttaaagcataccttaaagataacatttttttttgaaaagagtcaaattatttttgaaaggctgatatttttgatatttactaatattttatttatttctttttcccttaaaataagagctaaatctgtttttattatcatttatcaagctctattaatacctcaactttttcaagaaaaaataataataatttttccctctattctcatgaccttttaggaaaattaattttagaaaaactattgacaaacccataaaaaatgagataagattatagattgtcactggtattttatactagaggcaaattatatttatatatacaaaaatgctgtataaaaaacatctcatatgattaaggcttatgctgcattagaagctaatggtaaattacaaccttttgaatacgatcccggtgctttaggtgcaaatgaagtagaaattgaggttcagtattgtggtgtatgtcattctgatttatctatgattaacaacgaatggggaatttccaattatcccttagttcctggacacgaagttgttggtactgtagcagctatgggagaaggagttaatcatgttgaagtaggtgacttagtaggtttgggatggcattctggttactgtatgacctgtcatagttgtttatctggttatcacaacttatgtgcaactgctgaaagtaccattgttggtcattacggtggttttggtgatagagtaagagctaaaggagttagtgttgttaaattaccaaaaggtatcgacttagcaagtgcaggtcctctcttttgtgggggtattactgtttttagtcctatggttgaattaagtttaaagccaactgcaaaagtagccgtcattggtattggaggattgggacacttagctgttcaatttctccgtgcatggggatgtgaagttactgcctttacttctagtgctcgtaaacaaaccgaggtattagaattaggagcacaccatatcttagattccaccaaccctgaagctatcgctagtgcagagggaaaattcgattatattattagtactgttaatttgaaattagattggaacctctacatctctactttagctccccaaggtcattttcactttgttggagttgtattagaacccctcgatttaaacttattccctttattaatgggacaacgttctgttagtgcatctcctgttggatctcccgctactattgctaccatgttagattttgcagtacgtcacgatattaaacctgtagtagaacaattctctttcgatcaaatcaacgaagctattgctcatttagaaagtggtaaggctcattaccgtgttgttttatctcactctaaaaactaactagatctctgcagagaatataaaaagccagattattaatccggcttttttattatttaaatactgtgcacgatcctgcaggatcatcttgctgaaaaactcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgccctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttgaatatttttcgtcagatacgcaaaccttacaaacataattaacaactgaaactattgatatgtctaggttttagctctatcacaggttggatctg

SEQ ID NO: 48 - DNA, 12648 bp, Cyanobacterium sp. ABICyano1
tcgacaattaataacttcttcctgtacgggcgaatggccatttgctcctaactaactccgtactgctttgcggaacgagcgtagcgaactctccgaattactaagccttcatccctgatagatgcaaaaaacgaattaaaattatgtgtaaaaagaaaatgtgtctttatttagtagtcaaagttacaaaatattaagaatcaaattaataatgtattgggcagttaagtatataagtctttaaatatttatttgtattcaatatattaaccgaggacaaattatgaattcttacactgttggaacctatttagcagaacgtttagttcaaattggtctcaaacaccattttgcagtagctggtgattataatttagttttattggataacttattgttaaataagaatatggaacaagtgtattgttgtaatgaattaaactgtggtttttctgctgagggatatgctcgtgcaaaaggtgctgccgcagcagttgttacttattctgttggagcattaagtgcttttgacgctattggaggtgcttatgcagaaaatttacctgtaatcttaatctctggtgcacccaataacaacgatcacgctgctggtcatgtattgcatcatgctttaggtaaaaccgattatcattaccaattagaaatggcaaaaaatattaccgctgccgcagaagctatttatactcccgaagaagcacctgctaagatcgatcacgtaattaaaaccgctctccgtgagaaaaaacccgtatatttagaaatcgcttgcaatatcgcttctatgccttgtgcagctcctggacctgctagtgctttatttaacgatgaagcatctgatgaggctagtttaaatgccgctgttgaagaaactttgaaatttattgctaatcgtgataaagtagctgttttagttggttctaaactccgtgccgctggtgcagaagaagcggctgtaaaattcgcagatgccttaggaggtgctgttgccacaatggcagccgctaaaagttttttccccgaagaaaatcctcattacattggtacttcttggggtgaggtatcttaccctggtgtagaaaaaaccatgaaggaagctgatgcagtaattgcattagctcctgttttcaatgattactctaccactggttggactgatattccagaccccaaaaaattagttttagcagaacctcgctctgtagttgtgaatggtgttagatttcccagtgtacatctcaaagattatttaactcgtttagctcaaaaagtgagtaaaaagactggcgcactcgatttctttaaatctttaaatgctggtgaattaaagaaagcagctcctgctgatcccagtgctcctttagtgaatgccgaaatcgcaagacaagttgaagccttgttaactcctaacactaccgttattgccgagactggtgatagttggttcaatgctcaacgcatgaaattacccaatggtgctcgtgttgagtatgaaatgcaatggggtcacattggatggtctgttcctgctgcatttggatatgcagttggagcacctgagcgtagaaacattttaatggtaggtgatggttctttccaactcactgctcaagaagttgcacaaatggtacgtttaaaattgcctgttattatctttctcattaacaactatggttacaccattgaagttatgattcatgatggtccttataataacattaagaattgggattacgcaggtttaatggaggtatttaacggtaatggtggatacgacagtggagcaggtaaaggattaaaagctaaaacaggaggtgagttagctgaagcaattaaagtagctttagccaatacagatggtcctaccttaatcgaatgtttcattggacgtgaagattgtactgaagagttagttaaatggggaaagcgtgttgccgctgcaaattctcgtaaacctgtaaacaaactcttgtagttaggatccgagctcagcaagtttcatcccgaccccctcagggtcgggatttttttattgtactagttgacataagtaaaggcatcccctgcgtgatataattaccttcagtttaaggaggtatacacatatgattaaagcctacgctgccctggaagccaacggaaaactccaaccctttgaatacgaccccggtgccctgggtgctaatgaggtggagattgaggtgcagtattgtggggtgtgccacagtgatttgtccatgattaataacgaatggggcatttccaattaccccctagtgccgggtcatgaggtggtgggtactgtggccgccatgggcgaaggggtgaaccatgttgaggtgggggatttagtggggctgggttggcattcgggctactgcatgacctgccatagttgtttatctggctaccacaacctttgtgccacggcggaatcgaccattgtgggccactacggtggctttggcgatcgggttcgggccaagggagtcagcgtggtgaaattacctaaaggcattgacctagccagtgccgggccccttttctgtggaggaattaccgttttcagtcctatggtggaactgagtttaaagcccactgcaaaagtggcagtgatcggcattgggggcttgggccatttagcggtgcaatttctccgggcctggggctgtgaagtgactgcctttacctccagtgccaggaagcaaacggaagtgttggaattgggcgctcaccacatactagattccaccaatccagaggcgatcgccagtgcggaaggcaaatttgactatattatctccactgtgaacctgaagcttgactggaacttatacatcagcaccctggcgccccagggacatttccactttgttggggtggtgttggagcctttggatctaaatctttttccccttttgatgggacaacgctccgtttctgcctccccagtgggtagtcccgccaccattgccaccatgttggactttgctgtgcgccatgacattaaacccgtggtggaacaatttagctttgatcagatcaacgaggcgatcgcccatctagaaagcggcaaagcccattatcgggtagtgctcagccatagtaaaaattagctctgcaaaggttgcttctgggtccgtggaacgctcggttgccgccgggcgttttttattcctgcaggatcatcttgctgaaaaactcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgccctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttgaatatttttcgtcagatacgcaaaccttacaaacataattaacaactgaaactattgatatgtctaggttttagctctatcacaggttggatctg

SEQ ID NO: 49 - DNA, 13165 bp, Cyanobacterium sp. ABICyano1
gatccagcaagtttcatcccgaccccctcagggtcgggatttttttattgtgagctcctccgcttaaaaaatttcatttttcgatcaaaaaagacaaattattactaattagctcatggcaataaataatcagtagtaatctgttttcacattttattgttaatttttattattgctaatatcaaccttttctacttctgcttaatattttatttatgctcaatgggaaaatctgaaataagattgagaacagtgttaccaatagaagtatttaaggtttaaagcataccttaaagataacatttttttttgaaaagagtcaaattatttttgaaaggctgatatttttgatatttactaatattttatttatttctttttcccttaaaataagagctaaatctgtttttattatcatttatcaagctctattaatacctcaactttttcaagaaaaaataataataatttttccctctattctcatgaccttttaggaaaattaattttagaaaaactattgacaaacccataaaaaatgagataagattatagattgtcactggtattttatactagaggcaaattatatttatatatacaaaaatgctgtataaaaaacatctcatatgattaaggcttatgctgcattagaagctaatggtaaattacaaccttttgaatacgatcccggtgctttaggtgcaaatgaagtagaaattgaggttcagtattgtggtgtatgtcattctgatttatctatgattaacaacgaatggggaatttccaattatcccttagttcctggacacgaagttgttggtactgtagcagctatgggagaaggagttaatcatgttgaagtaggtgacttagtaggtttgggatggcattctggttactgtatgacctgtcatagttgtttatctggttatcacaacttatgtgcaactgctgaaagtaccattgttggtcattacggtggttttggtgatagagtaagagctaaaggagttagtgttgttaaattaccaaaaggtatcgacttagcaagtgcaggtcctctcttttgtgggggtattactgtttttagtcctatggttgaattaagtttaaagccaactgcaaaagtagccgtcattggtattggaggattgggacacttagctgttcaatttctccgtgcatggggatgtgaagttactgcctttacttctagtgctcgtaaacaaaccgaggtattagaattaggagcacaccatatcttagattccaccaaccctgaagctatcgctagtgcagagggaaaattcgattatattattagtactgttaatttgaaattagattggaacctctacatctctactttagctccccaaggtcattttcactttgttggagttgtattagaacccctcgatttaaacttattccctttattaatgggacaacgttctgttagtgcatctcctgttggatctcccgctactattgctaccatgttagattttgcagtacgtcacgatattaaacctgtagtagaacaattctctttcgatcaaatcaacgaagctattgctcatttagaaagtggtaaggctcattaccgtgttgttttatctcactctaaaaactaactagatctctgcagagaatataaaaagccagattattaatccggcttttttattatttaaatactgtgcacgatcctgcaggatcatcttgctgaaaaactcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgccctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttgaatatttttcgtcagatacgcaaaccttacaaacataattaacaactgaaactattgatatgtctaggttttagctctatcacaggttggatctgtcgacaattaataacttcttcctgtacgggcgaatggccatttgctcctaactaactccgtactgctttgcggaacgagcgtagcgaactctccgaattactaagccttcatccctgatagatgcaaaaaacgaattaaaattatgtgtaaaaagaaaatgtgtctttatttagtagtcaaagttacaaaatattaagaatcaaattaataatgtattgggcagttaagtatataagtctttaaatatttatttgtattcaatatattaaccgaggacaaattatgaattcttacactgttggaacctatttagcagaacgtttagttcaaattggtctcaaacaccattttgcagtagctggtgattataatttagttttattggataacttattgttaaataagaatatggaacaagtgtattgttgtaatgaattaaactgtggtttttctgctgagggatatgctcgtgcaaaaggtgctgccgcagcagttgttacttattctgttggagcattaagtgcttttgacgctattggaggtgcttatgcagaaaatttacctgtaatcttaatctctggtgcacccaataacaacgatcacgctgctggtcatgtattgcatcatgctttaggtaaaaccgattatcattaccaattagaaatggcaaaaaatattaccgctgccgcagaagctatttatactcccgaagaagcacctgctaagatcgatcacgtaattaaaaccgctctccgtgagaaaaaacccgtatatttagaaatcgcttgcaatatcgcttctatgccttgtgcagctcctggacctgctagtgctttatttaacgatgaagcatctgatgaggctagtttaaatgccgctgttgaagaaactttgaaatttattgctaatcgtgataaagtagctgttttagttggttctaaactccgtgccgctggtgcagaagaagcggctgtaaaattcgcagatgccttaggaggtgctgttgccacaatggcagccgctaaaagttttttccccgaagaaaatcctcattacattggtacttcttggggtgaggtatcttaccctggtgtagaaaaaaccatgaaggaagctgatgcagtaattgcattagctcctgttttcaatgattactctaccactggttggactgatattccagaccccaaaaaattagttttagcagaacctcgctctgtagttgtgaatggtgttagatttcccagtgtacatctcaaagattatttaactcgtttagctcaaaaagtgagtaaaaagactggcgcactcgatttctttaaatctttaaatgctggtgaattaaagaaagcagctcctgctgatcccagtgctcctttagtgaatgccgaaatcgcaagacaagttgaagccttgttaactcctaacactaccgttattgccgagactggtgatagttggttcaatgctcaacgcatgaaattacccaatggtgctcgtgttgagtatgaaatgcaatggggtcacattggatggtctgttcctgctgcatttggatatgcagttggagcacctgagcgtagaaacattttaatggtaggtgatggttctttccaactcactgctcaagaagttgcacaaatggtacgtttaaaattgcctgttattatctttctcattaacaactatggttacaccattgaagttatgattcatgatggtccttataataacattaagaattgggattacgcaggtttaatggaggtatttaacggtaatggtggatacgacagtggagcaggtaaaggattaaaagctaaaacaggaggtgagttagctgaagcaattaaagtagctttagccaatacagatggtcctaccttaatcgaatgtttcattggacgtgaagattgtactgaagagttagttaaatggggaaagcgtgttgccgctgcaaattctcgtaaacctgtaaacaaactcttgtagttag

SEQ ID NO: 50 - DNA, 13604 bp, Cyanobacterium sp. ABICyano1
aatatttttcgtcagatacgcaaaccttacaaacataattaacaactgaaactattgatatgtctaggttttagctctatcacaggttggatctgtcgactttatatataaactcgaataaaattatcaatataaagtcaaactatatctatcctattttaactgctattggtaagtcccttaattagtgttggggtgaatagattttaaaagggcaaacccccctttatcctccctcgagaggggggagggcaaaaggcaaggggcaagggaaaaattaagaattaagaattaaaaactccgaacacctgtaggggcgaatagccattcgcttcccctcatccccccatctccccaacaccctaagcccctactcgttactcatttatttacatcatttatttacatcattaagaaaagtaacaaattttgacaagtagtcttttgacaggaaaaagcaaattctcgaagatgaaaacaatagaaaaaaattcaatcttacagtaacgatgaaaaaacttttaggcttaattatgaattcttataccgtgggtacttatttagccgaacgcttagtgcaaattggtttaaaacatcattttgccgtggctggggactataatttagtgttattggataacttattattaaataaaaacatggaacaagtgtattgttgtaatgaattaaattgtggtttttctgctgaaggttatgctagagctaaaggtgcagctgctgctgttgttacttattctgtgggtgctttatctgcttttgatgctattggtggtgcttatgccgaaaatttacccgtgattttaatttctggtgcccctaataataatgatcatgccgctggacatgttttacatcatgccttaggtaaaaccgattatcattatcaattagaaatggccaaaaatattactgctgctgccgaagctatttatactcctgaagaagcccctgccaaaattgatcatgtgattaaaaccgccttacgcgaaaaaaaacccgtgtatttagaaattgcctgtaatattgcttctatgccttgtgctgctcctgggcctgcttctgctttatttaatgatgaagcctctgatgaagctagtttaaatgctgccgtggaagaaaccttaaaatttattgccaatcgcgataaagttgccgtgttagttggttctaaattaagagctgctggtgctgaagaagctgctgttaaatttgctgatgctttaggtggtgcagttgctactatggctgctgccaaatctttttttcccgaagaaaatccccattatattggaactagttggggagaagtttcttatcctggtgtggaaaaaactatgaaagaagccgacgctgttattgctttagcccctgtgtttaatgattattctaccactggttggactgatattcccgatcccaaaaaattagttttagccgaacctcgttctgttgttgttaatggtgttcgctttccctctgtgcatttaaaagattatttaacccgcttagcccaaaaagtttctaaaaaaactggtgccttagatttttttaaatctttaaatgcgggtgaattaaaaaaagctgctcctgctgatccttctgctcctttagttaatgctgaaattgcccgtcaagttgaagccttattaacccctaatactaccgttattgccgaaactggtgattcttggtttaatgcccaacgcatgaaattacctaatggtgcccgtgttgaatatgaaatgcaatggggtcatattggttggtctgtacctgctgcttttggttatgctgttggtgctcctgaacgtcgtaatattttaatggtgggtgatggttcttttcaattaactgcccaagaagttgcccaaatggttcgcttaaaattacccgttattatttttttaataaataattatggttataccattgaagtgatgattcatgatgggccatataataatattaaaaattgggattatgcgggtttaatggaagtgtttaatggtaatggtggttatgattctggtgctggtaaaggtttaaaagccaaaactggtggtgaattagctgaagctattaaagttgccttagccaatactgatgggccaaccttaattgaatgttttattggtcgcgaagattgtaccgaagaattagttaaatggggtaaacgtgttgctgctgctaattctcgcaaacccgtgaataaattattgtaatttttggggatcaattcgagctcctccgcttaaaaaatttcatttttcgatcaaaaaagacaaattattactaattagctcatggcaataaataatcagtagtaatctgttttcacattttattgttaatttttattattgctaatatcaaccttttctacttctgcttaatattttatttatgctcaatgggaaaatctgaaataagattgagaacagtgttaccaatagaagtatttaaggtttaaagcataccttaaagataacatttttttttgaaaagagtcaaattatttttgaaaggctgatatttttgatatttactaatattttatttatttctttttcccttaaaataagagctaaatctgtttttattatcatttatcaagctctattaatacctcaactttttcaagaaaaaataataataatttttccctctattctcatgaccttttaggaaaattaattttagaaaaactattgacaaacccataaaaaatgagataagattatagattgtcactggtattttatactagaggcaaattatatttatatatacaaaaatgctgtataaaaaacatctcatatgattaaagcctatgctgccttagaagccaatggtaaattacaaccctttgaatatgatcctggtgctttaggtgccaatgaagtggaaattgaagtgcaatattgtggtgtgtgtcattctgatttatctatgattaataatgaatggggtatttctaattatcccttagttcctggtcatgaagttgttggtactgttgctgctatgggtgaaggtgttaatcatgtggaagtgggtgatttagttggtttaggttggcattctggttattgtatgacctgtcattcttgtttatctggttatcataatttatgtgccactgccgaatctactattgtgggtcattatggtggttttggtgatagagttcgtgctaaaggtgtttctgtggtgaaattacccaaaggtattgatttagcctctgctgggcctttattttgtggtggtattaccgttttttctcccatggtggaattatctttaaaacctaccgccaaagttgctgttattggtattggtggtttaggtcatttagccgttcaatttttaagagcctggggttgtgaagttactgcttttacctcttctgcccgtaaacaaaccgaagttttagaattaggtgcccatcatattttagattctaccaatcctgaagctattgcttctgccgaaggtaaatttgattatattatttctaccgtgaatttaaaattagattggaatttatatatcagtaccttagcccctcaaggtcattttcattttgttggtgtggtgttagaacccttggacttaaacttatttcccttattaatgggacaacgttctgtttctgcttctcctgttggttctcctgctactattgccactatgttagattttgccgtgcgtcatgatattaaacccgtggtggaacaattttcttttgatcaaattaatgaagccattgcccatttagaatctggtaaagcccattatcgcgtggtgttatctcattctaaaaattaataagattaacttctaaactgaaacaaatttgagggtaggcttcattgtctgcccttatttttttatttaggaaaagtgaacagactaaagagtgttggctctattgctttgagtatgtaaattaggcgttgctgaattaaggtatgatttttgaccccttctctcttctgcagttacctaggatttctggcgaaagggggatgtgctgcaaggcgattaagttgggtaacgccagggttttcccagtcacgacgttgtaaaacgacggccagtgagcgcgacgtaatacgactcactatagggcgaattggcggaaggccgtcaaggccgcatggcgcgcctacgtagacaattgtcgatgtaattattaactatcttattatagatgaggggagagggagaaattagttcggagagaacgctcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgtcctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttg

SEQ ID NO: 51 - DNA, 12763 bp, Cyanobacterium sp. ABICyano1
tcgacaattaataacttcttcctgtacgggcgaatggccatttgctcctaactaactccgtactgctttgcggaacgagcgtagcgaactctccgaattactaagccttcatccctgatagatgcaaaaaacgaattaaaattatgtgtaaaaagaaaatgtgtctttatttagtagtcaaagttacaaaatattaagaatcaaattaataatgtattgggcagttaagtatataagtctttaaatatttatttgtattcaatatattaaggaggatcagccttatgaattcttataccgtgggtacttatttagccgaacgcttagtgcaaattggtttaaaacatcattttgccgtggctggggactataatttagtgttattggataacttattattaaataaaaacatggaacaagtgtattgttgtaatgaattaaattgtggtttttctgctgaaggttatgctagagctaaaggtgcagctgctgctgttgttacttattctgtgggtgctttatctgcttttgatgctattggtggtgcttatgccgaaaatttacccgtgattttaatttctggtgcccctaataataatgatcatgccgctggacatgttttacatcatgccttaggtaaaaccgattatcattatcaattagaaatggccaaaaatattactgctgctgccgaagctatttatactcctgaagaagcccctgccaaaattgatcatgtgattaaaaccgccttacgcgaaaaaaaacccgtgtatttagaaattgcctgtaatattgcttctatgccttgtgctgctcctgggcctgcttctgctttatttaatgatgaagcctctgatgaagctagtttaaatgctgccgtggaagaaaccttaaaatttattgccaatcgcgataaagttgccgtgttagttggttctaaattaagagctgctggtgctgaagaagctgctgttaaatttgctgatgctttaggtggtgcagttgctactatggctgctgccaaatctttttttcccgaagaaaatccccattatattggaactagttggggagaagtttcttatcctggtgtggaaaaaactatgaaagaagccgacgctgttattgctttagcccctgtgtttaatgattattctaccactggttggactgatattcccgatcccaaaaaattagttttagccgaacctcgttctgttgttgttaatggtgttcgctttccctctgtgcatttaaaagattatttaacccgcttagcccaaaaagtttctaaaaaaactggtgccttagatttttttaaatctttaaatgcgggtgaattaaaaaaagctgctcctgctgatccttctgctcctttagttaatgctgaaattgcccgtcaagttgaagccttattaacccctaatactaccgttattgccgaaactggtgattcttggtttaatgcccaacgcatgaaattacctaatggtgcccgtgttgaatatgaaatgcaatggggtcatattggttggtctgtacctgctgcttttggttatgctgttggtgctcctgaacgtcgtaatattttaatggtgggtgatggttcttttcaattaactgcccaagaagttgcccaaatggttcgcttaaaattacccgttattatttttttaataaataattatggttataccattgaagtgatgattcatgatgggccatataataatattaaaaattgggattatgcgggtttaatggaagtgtttaatggtaatggtggttatgattctggtgctggtaaaggtttaaaagccaaaactggtggtgaattagctgaagctattaaagttgccttagccaatactgatgggccaaccttaattgaatgttttattggtcgcgaagattgtaccgaagaattagttaaatggggtaaacgtgttgctgctgctaattctcgcaaacccgtgaataaattattgtaatttttggggatcaattcgagctcagcaagtttcatcccgaccccctcagggtcgggatttttttattgtactagttgacataagtaaaggcatcccctgcgtgatataattaccttcagtttaaggaggtatacacatatgattaaagcctatgctgccttagaagccaatggtaaattacaaccctttgaatatgatcctggtgctttaggtgccaatgaagtggaaattgaagtgcaatattgtggtgtgtgtcattctgatttatctatgattaataatgaatggggtatttctaattatcccttagttcctggtcatgaagttgttggtactgttgctgctatgggtgaaggtgttaatcatgtggaagtgggtgatttagttggtttaggttggcattctggttattgtatgacctgtcattcttgtttatctggttatcataatttatgtgccactgccgaatctactattgtgggtcattatggtggttttggtgatagagttcgtgctaaaggtgtttctgtggtgaaattacccaaaggtattgatttagcctctgctgggcctttattttgtggtggtattaccgttttttctcccatggtggaattatctttaaaacctaccgccaaagttgctgttattggtattggtggtttaggtcatttagccgttcaatttttaagagcctggggttgtgaagttactgcttttacctcttctgcccgtaaacaaaccgaagttttagaattaggtgcccatcatattttagattctaccaatcctgaagctattgcttctgccgaaggtaaatttgattatattatttctaccgtgaatttaaaattagattggaatttatatatcagtaccttagcccctcaaggtcattttcattttgttggtgtggtgttagaacccttggacttaaacttatttcccttattaatgggacaacgttctgtttctgcttctcctgttggttctcctgctactattgccactatgttagattttgccgtgcgtcatgatattaaacccgtggtggaacaattttcttttgatcaaattaatgaagccattgcccatttagaatctggtaaagcccattatcgcgtggtgttatctcattctaaaaattaataagattaacttctaaactgaaacaaatttgagggtaggcttcattgtctgcccttatttttttatttaggaaaagtgaacagactaaagagtgttggctctattgctttgagtatgtaaattaggcgttgctgaattaaggtatgatttttgaccccttctctcttctgcaggatcatcttgctgaaaaactcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgccctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttgaatatttttcgtcagatacgcaaaccttacaaacataattaacaactgaaactattgatatgtctaggttttagctctatcacaggttggatctg

SEQ ID NO: 52 - DNA, 12762 bp, Cyanobacterium sp. ABICyano1
tcgacaattaataacttcttcctgtacgggcgaatggccatttgctcctaactaactccgtactgctttgcggaacgagcgtagcgaactctccgaattactaagccttcatccctgatagatgcaaaaaacgcattaaaattatgcgtaaaaagcatatttgtctttatttagtaatcaaagttacaaattattaagaatcaaattaataatatattgggcagttaagtatataagtctttaaatatttatttgtattcaatatattaaccgaggacaaattatgaattcttataccgtgggtacttatttagccgaacgcttagtgcaaattggtttaaaacatcattttgccgtggctggggactataatttagtgttattggataacttattattaaataaaaacatggaacaagtgtattgttgtaatgaattaaattgtggtttttctgctgaaggttatgctagagctaaaggtgcagctgctgctgttgttacttattctgtgggtgctttatctgcttttgatgctattggtggtgcttatgccgaaaatttacccgtgattttaatttctggtgcccctaataataatgatcatgccgctggacatgttttacatcatgccttaggtaaaaccgattatcattatcaattagaaatggccaaaaatattactgctgctgccgaagctatttatactcctgaagaagcccctgccaaaattgatcatgtgattaaaaccgccttacgcgaaaaaaaacccgtgtatttagaaattgcctgtaatattgcttctatgccttgtgctgctcctgggcctgcttctgctttatttaatgatgaagcctctgatgaagctagtttaaatgctgccgtggaagaaaccttaaaatttattgccaatcgcgataaagttgccgtgttagttggttctaaattaagagctgctggtgctgaagaagctgctgttaaatttgctgatgctttaggtggtgcagttgctactatggctgctgccaaatctttttttcccgaagaaaatccccattatattggaactagttggggagaagtttcttatcctggtgtggaaaaaactatgaaagaagccgacgctgttattgctttagcccctgtgtttaatgattattctaccactggttggactgatattcccgatcccaaaaaattagttttagccgaacctcgttctgttgttgttaatggtgttcgctttccctctgtgcatttaaaagattatttaacccgcttagcccaaaaagtttctaaaaaaactggtgccttagatttttttaaatctttaaatgcgggtgaattaaaaaaagctgctcctgctgatccttctgctcctttagttaatgctgaaattgcccgtcaagttgaagccttattaacccctaatactaccgttattgccgaaactggtgattcttggtttaatgcccaacgcatgaaattacctaatggtgcccgtgttgaatatgaaatgcaatggggtcatattggttggtctgtacctgctgcttttggttatgctgttggtgctcctgaacgtcgtaatattttaatggtgggtgatggttcttttcaattaactgcccaagaagttgcccaaatggttcgcttaaaattacccgttattatttttttaataaataattatggttataccattgaagtgatgattcatgatgggccatataataatattaaaaattgggattatgcgggtttaatggaagtgtttaatggtaatggtggttatgattctggtgctggtaaaggtttaaaagccaaaactggtggtgaattagctgaagctattaaagttgccttagccaatactgatgggccaaccttaattgaatgttttattggtcgcgaagattgtaccgaagaattagttaaatggggtaaacgtgttgctgctgctaattctcgcaaacccgtgaataaattattgtaatttttggggatcaattcgagctcagcaagtttcatcccgaccccctcagggtcgggatttttttattgtactagttgacataagtaaaggcatcccctgcgtgatataattaccttcagtttaaggaggtatacacatatgattaaagcctatgctgccttagaagccaatggtaaattacaaccctttgaatatgatcctggtgctttaggtgccaatgaagtggaaattgaagtgcaatattgtggtgtgtgtcattctgatttatctatgattaataatgaatggggtatttctaattatcccttagttcctggtcatgaagttgttggtactgttgctgctatgggtgaaggtgttaatcatgtggaagtgggtgatttagttggtttaggttggcattctggttattgtatgacctgtcattcttgtttatctggttatcataatttatgtgccactgccgaatctactattgtgggtcattatggtggttttggtgatagagttcgtgctaaaggtgtttctgtggtgaaattacccaaaggtattgatttagcctctgctgggcctttattttgtggtggtattaccgttttttctcccatggtggaattatctttaaaacctaccgccaaagttgctgttattggtattggtggtttaggtcatttagccgttcaatttttaagagcctggggttgtgaagttactgcttttacctcttctgcccgtaaacaaaccgaagttttagaattaggtgcccatcatattttagattctaccaatcctgaagctattgcttctgccgaaggtaaatttgattatattatttctaccgtgaatttaaaattagattggaatttatatatcagtaccttagcccctcaaggtcattttcattttgttggtgtggtgttagaacccttggacttaaacttatttcccttattaatgggacaacgttctgtttctgcttctcctgttggttctcctgctactattgccactatgttagattttgccgtgcgtcatgatattaaacccgtggtggaacaattttcttttgatcaaattaatgaagccattgcccatttagaatctggtaaagcccattatcgcgtggtgttatctcattctaaaaattaataagattaacttctaaactgaaacaaatttgagggtaggcttcattgtctgcccttatttttttatttaggaaaagtgaacagactaaagagtgttggctctattgctttgagtatgtaaattaggcgttgctgaattaaggtatgatttttgaccccttctctcttctgcaggatcatcttgctgaaaaactcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgccctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttgaatatttttcgtcagatacgcaaaccttacaaacataattaacaactgaaactattgatatgtctaggttttagctctatcacaggttggatctg

SEQ ID NO: 53 - DNA, 13726 bp, Cyanobacterium sp. ABICyano1
tcgaccatgcgtccaaaactttcaccatcctttccctatcaacctttactgcactaaagacaagtgagatagcagtggcaatctggctttgcaatcaatgtttccactaaagcgtttagcgttactgcggctagaagtcctccaccgaggctcccctgaatggtgatatggggaatgggactggtcatcagtcgtcgttttgcccccggagcatgactaaaaccgatcggcattccgatcacaagagccggctgaatatgttgttgctctatcagcttacaggcagtgagtaaaacagaaggggcatagccgatcgccagcacacatccttggggaatctgttgtaaccgctgttgccaatggtcatggtgccaaaaagcttgctcggcttccctaagccctgtgatgtgagggtcgtcaatcagcgttttaaccgtacatcctaaatgagctaaccgagtttgatcaagagccgcagccacaaccggaacatcggtgacgactggacaccctgctttcagtgcatctcgtgccgaggcgatcgctccctgactcaatcgaacggcgtttaccaagctaacatcaccacaggccagcactaattgatgtagtaagtgaatggtaatttcagagtaagccgataaatccggtagcaggtgtttgagggattcctgaaaggcttctggatgagttgttgtctccgcatctaggttcgtccacaactgatcgagttttcctaacccctcctggacatccacatcaagctgtttcagttgggccagagcttccgcttgggtaatctggcaactctggtcgcgtcccagtaatccttctaaagcagatgcggtttggcggagtcgagtaatctgctgaatcacagcctgatattgctgttgcaactgcaccattagggtgggatcaaggctctcttcagaatggctatccagcagttgccgaatatgagacaactgaaagccctgctgtttgagggcaatgactcgttggagccgttgtacgtcctgctgagtataaaggcggtagttgccctctgagcgttgaacggggggaagcaatcccagggtgtggtaatggcgcaccatgcgaggcgtaacgccacctcccactgcatctgtgagttctttaatcgttaagtgattagtcttcatgactttagtttactcaaaaccttgacattgacactaatgttaaggtttaggctgagaaggtaaaaatcgaggataaaaagcatgaattcttataccgtgggtacttatttagccgaacgcttagtgcaaattggtttaaaacatcattttgccgtggctggggactataatttagtgttattggataacttattattaaataaaaacatggaacaagtgtattgttgtaatgaattaaattgtggtttttctgctgaaggttatgctagagctaaaggtgcagctgctgctgttgttacttattctgtgggtgctttatctgcttttgatgctattggtggtgcttatgccgaaaatttacccgtgattttaatttctggtgcccctaataataatgatcatgccgctggacatgttttacatcatgccttaggtaaaaccgattatcattatcaattagaaatggccaaaaatattactgctgctgccgaagctatttatactcctgaagaagcccctgccaaaattgatcatgtgattaaaaccgccttacgcgaaaaaaaacccgtgtatttagaaattgcctgtaatattgcttctatgccttgtgctgctcctgggcctgcttctgctttatttaatgatgaagcctctgatgaagctagtttaaatgctgccgtggaagaaaccttaaaatttattgccaatcgcgataaagttgccgtgttagttggttctaaattaagagctgctggtgctgaagaagctgctgttaaatttgctgatgctttaggtggtgcagttgctactatggctgctgccaaatctttttttcccgaagaaaatccccattatattggaactagttggggagaagtttcttatcctggtgtggaaaaaactatgaaagaagccgacgctgttattgctttagcccctgtgtttaatgattattctaccactggttggactgatattcccgatcccaaaaaattagttttagccgaacctcgttctgttgttgttaatggtgttcgctttccctctgtgcatttaaaagattatttaacccgcttagcccaaaaagtttctaaaaaaactggtgccttagatttttttaaatctttaaatgcgggtgaattaaaaaaagctgctcctgctgatccttctgctcctttagttaatgctgaaattgcccgtcaagttgaagccttattaacccctaatactaccgttattgccgaaactggtgattcttggtttaatgcccaacgcatgaaattacctaatggtgcccgtgttgaatatgaaatgcaatggggtcatattggttggtctgtacctgctgcttttggttatgctgttggtgctcctgaacgtcgtaatattttaatggtgggtgatggttcttttcaattaactgcccaagaagttgcccaaatggttcgcttaaaattacccgttattatttttttaataaataattatggttataccattgaagtgatgattcatgatgggccatataataatattaaaaattgggattatgcgggtttaatggaagtgtttaatggtaatggtggttatgattctggtgctggtaaaggtttaaaagccaaaactggtggtgaattagctgaagctattaaagttgccttagccaatactgatgggccaaccttaattgaatgttttattggtcgcgaagattgtaccgaagaattagttaaatggggtaaacgtgttgctgctgctaattctcgcaaacccgtgaataaattattgtaatttttggggatcaattcgagctcagcaagtttcatcccgaccccctcagggtcgggatttttttattgtactagttgacataagtaaaggcatcccctgcgtgatataattaccttcagtttaaggaggtatacacatatgattaaagcctatgctgccttagaagccaatggtaaattacaaccctttgaatatgatcctggtgctttaggtgccaatgaagtggaaattgaagtgcaatattgtggtgtgtgtcattctgatttatctatgattaataatgaatggggtatttctaattatcccttagttcctggtcatgaagttgttggtactgttgctgctatgggtgaaggtgttaatcatgtggaagtgggtgatttagttggtttaggttggcattctggttattgtatgacctgtcattcttgtttatctggttatcataatttatgtgccactgccgaatctactattgtgggtcattatggtggttttggtgatagagttcgtgctaaaggtgtttctgtggtgaaattacccaaaggtattgatttagcctctgctgggcctttattttgtggtggtattaccgttttttctcccatggtggaattatctttaaaacctaccgccaaagttgctgttattggtattggtggtttaggtcatttagccgttcaatttttaagagcctggggttgtgaagttactgcttttacctcttctgcccgtaaacaaaccgaagttttagaattaggtgcccatcatattttagattctaccaatcctgaagctattgcttctgccgaaggtaaatttgattatattatttctaccgtgaatttaaaattagattggaatttatatatcagtaccttagcccctcaaggtcattttcattttgttggtgtggtgttagaacccttggacttaaacttatttcccttattaatgggacaacgttctgtttctgcttctcctgttggttctcctgctactattgccactatgttagattttgccgtgcgtcatgatattaaacccgtggtggaacaattttcttttgatcaaattaatgaagccattgcccatttagaatctggtaaagcccattatcgcgtggtgttatctcattctaaaaattaataagattaacttctaaactgaaacaaatttgagggtaggcttcattgtctgcccttatttttttatttaggaaaagtgaacagactaaagagtgttggctctattgctttgagtatgtaaattaggcgttgctgaattaaggtatgatttttgaccccttctctcttctgcaggatcatcttgctgaaaaactcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgccctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttgaatatttttcgtcagatacgcaaaccttacaaacataattaacaactgaaactattgatatgtctaggttttagctctatcacaggttggatctg

SEQ ID NO: 54 - DNA, 13726 bp, Cyanobacterium sp. ABICyano1
tcgaccatgcgtccaaaactttcaccatcctttccctatcaacctttactgcactaaagacaagtgagatagcagtggcaatctggctttgcaatcaatgtttccactaaagcgtttagcgttactgcggctagaagtcctccaccgaggctcccctgaatggtgatatggggaatgggactggtcatcagtcgtcgttttgcccccggagcatgactaaaaccgatcggcattccgatcacaagagccggctgaatatgttgttgctctatcagcttacaggcagtgagtaaaacagaaggggcatagccgatcgccagcacacatccttggggaatctgttgtaaccgctgttgccaatggtcatggtgccaaaaagcttgctcggcttccctaagccctgtgatgtgagggtcgtcaatcagcgttttaaccgtacatcctaaatgagctaaccgagtttgatcaagagccgcagccacaaccggaacatcggtgacgactggacaccctgctttcagtgcatctcgtgccgaggcgatcgctccctgactcaatcgaacggcgtttaccaagctaacatcaccacaggccagcactaattgatgtagtaagtgaatggtaatttcagagtaagccgataaatccggtagcaggtgtttgagggattcctgaaaggcttctggatgagttgttgtctccgcatctaggttcgtccacaactgatcgagttttcctaacccctcctggacatccacatcaagctgtttcagttgggccagagcttccgcttgggtaatctggcaactctggtcgcgtcccagtaatccttctaaagcagatgcggtttggcggagtcgagtaatctgctgaatcacagcctgatattgctgttgcaactgcaccattagggtgggatcaaggctctcttcagaatggctatccagcagttgccgaatatgagacaactgaaagccctgctgtttgagggcaatgactcgttggagccgttgtacgtcctgctgagtataaaggcggtagttgccctctgagcgttgaacggggggaagcaatcccagggtgtggtaatggcgcaccatgcgaggcgtaacgccacctcccactgcatctgtgagttctttaatcgttaagtgattagtcttcatgactttagtttactcaaaaccttgacattgacactaatgttaaggtttagaatgagaaggtaaaaatccaagttaaaaagcatgaattcttataccgtgggtacttatttagccgaacgcttagtgcaaattggtttaaaacatcattttgccgtggctggggactataatttagtgttattggataacttattattaaataaaaacatggaacaagtgtattgttgtaatgaattaaattgtggtttttctgctgaaggttatgctagagctaaaggtgcagctgctgctgttgttacttattctgtgggtgctttatctgcttttgatgctattggtggtgcttatgccgaaaatttacccgtgattttaatttctggtgcccctaataataatgatcatgccgctggacatgttttacatcatgccttaggtaaaaccgattatcattatcaattagaaatggccaaaaatattactgctgctgccgaagctatttatactcctgaagaagcccctgccaaaattgatcatgtgattaaaaccgccttacgcgaaaaaaaacccgtgtatttagaaattgcctgtaatattgcttctatgccttgtgctgctcctgggcctgcttctgctttatttaatgatgaagcctctgatgaagctagtttaaatgctgccgtggaagaaaccttaaaatttattgccaatcgcgataaagttgccgtgttagttggttctaaattaagagctgctggtgctgaagaagctgctgttaaatttgctgatgctttaggtggtgcagttgctactatggctgctgccaaatctttttttcccgaagaaaatccccattatattggaactagttggggagaagtttcttatcctggtgtggaaaaaactatgaaagaagccgacgctgttattgctttagcccctgtgtttaatgattattctaccactggttggactgatattcccgatcccaaaaaattagttttagccgaacctcgttctgttgttgttaatggtgttcgctttccctctgtgcatttaaaagattatttaacccgcttagcccaaaaagtttctaaaaaaactggtgccttagatttttttaaatctttaaatgcgggtgaattaaaaaaagctgctcctgctgatccttctgctcctttagttaatgctgaaattgcccgtcaagttgaagccttattaacccctaatactaccgttattgccgaaactggtgattcttggtttaatgcccaacgcatgaaattacctaatggtgcccgtgttgaatatgaaatgcaatggggtcatattggttggtctgtacctgctgcttttggttatgctgttggtgctcctgaacgtcgtaatattttaatggtgggtgatggttcttttcaattaactgcccaagaagttgcccaaatggttcgcttaaaattacccgttattatttttttaataaataattatggttataccattgaagtgatgattcatgatgggccatataataatattaaaaattgggattatgcgggtttaatggaagtgtttaatggtaatggtggttatgattctggtgctggtaaaggtttaaaagccaaaactggtggtgaattagctgaagctattaaagttgccttagccaatactgatgggccaaccttaattgaatgttttattggtcgcgaagattgtaccgaagaattagttaaatggggtaaacgtgttgctgctgctaattctcgcaaacccgtgaataaattattgtaatttttggggatcaattcgagctcagcaagtttcatcccgaccccctcagggtcgggatttttttattgtactagttgacataagtaaaggcatcccctgcgtgatataattaccttcagtttaaggaggtatacacatatgattaaagcctatgctgccttagaagccaatggtaaattacaaccctttgaatatgatcctggtgctttaggtgccaatgaagtggaaattgaagtgcaatattgtggtgtgtgtcattctgatttatctatgattaataatgaatggggtatttctaattatcccttagttcctggtcatgaagttgttggtactgttgctgctatgggtgaaggtgttaatcatgtggaagtgggtgatttagttggtttaggttggcattctggttattgtatgacctgtcattcttgtttatctggttatcataatttatgtgccactgccgaatctactattgtgggtcattatggtggttttggtgatagagttcgtgctaaaggtgtttctgtggtgaaattacccaaaggtattgatttagcctctgctgggcctttattttgtggtggtattaccgttttttctcccatggtggaattatctttaaaacctaccgccaaagttgctgttattggtattggtggtttaggtcatttagccgttcaatttttaagagcctggggttgtgaagttactgcttttacctcttctgcccgtaaacaaaccgaagttttagaattaggtgcccatcatattttagattctaccaatcctgaagctattgcttctgccgaaggtaaatttgattatattatttctaccgtgaatttaaaattagattggaatttatatatcagtaccttagcccctcaaggtcattttcattttgttggtgtggtgttagaacccttggacttaaacttatttcccttattaatgggacaacgttctgtttctgcttctcctgttggttctcctgctactattgccactatgttagattttgccgtgcgtcatgatattaaacccgtggtggaacaattttcttttgatcaaattaatgaagccattgcccatttagaatctggtaaagcccattatcgcgtggtgttatctcattctaaaaattaataagattaacttctaaactgaaacaaatttgagggtaggcttcattgtctgcccttatttttttatttaggaaaagtgaacagactaaagagtgttggctctattgctttgagtatgtaaattaggcgttgctgaattaaggtatgatttttgaccccttctctcttctgcaggatcatcttgctgaaaaactcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgccctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttgaatatttttcgtcagatacgcaaaccttacaaacataattaacaactgaaactattgatatgtctaggttttagctctatcacaggttggatctg

SEQ ID NO: 55 - DNA, 13726 bp, Cyanobacterium sp. ABICyano1
tcgaccatgcgtccaaaactttcaccatcctttccctatcaacctttactgcactaaagacaagtgagatagcagtggcaatctggctttgcaatcaatgtttccactaaagcgtttagcgttactgcggctagaagtcctccaccgaggctcccctgaatggtgatatggggaatgggactggtcatcagtcgtcgttttgcccccggagcatgactaaaaccgatcggcattccgatcacaagagccggctgaatatgttgttgctctatcagcttacaggcagtgagtaaaacagaaggggcatagccgatcgccagcacacatccttggggaatctgttgtaaccgctgttgccaatggtcatggtgccaaaaagcttgctcggcttccctaagccctgtgatgtgagggtcgtcaatcagcgttttaaccgtacatcctaaatgagctaaccgagtttgatcaagagccgcagccacaaccggaacatcggtgacgactggacaccctgctttcagtgcatctcgtgccgaggcgatcgctccctgactcaatcgaacggcgtttaccaagctaacatcaccacaggccagcactaattgatgtagtaagtgaatggtaatttcagagtaagccgataaatccggtagcaggtgtttgagggattcctgaaaggcttctggatgagttgttgtctccgcatctaggttcgtccacaactgatcgagttttcctaacccctcctggacatccacatcaagctgtttcagttgggccagagcttccgcttgggtaatctggcaactctggtcgcgtcccagtaatccttctaaagcagatgcggtttggcggagtcgagtaatctgctgaatcacagcctgatattgctgttgcaactgcaccattagggtgggatcaaggctctcttcagaatggctatccagcagttgccgaatatgagacaactgaaagccctgctgtttgagggcaatgactcgttggagccgttgtacgtcctgctgagtataaaggcggtagttgccctctgagcgttgaacggggggaagcaatcccagggtgtggtaatggcgcaccatgcgaggcgtaacgccacctcccactgcatctgtgagttctttaatcgttaagtgattagtcttcatgactttagtttactcaaaaccttgacattgacactaatgttaaggtttagaatgagaaggtaaaaatcgaggataaaaagcatgaattcttataccgtgggtacttatttagccgaacgcttagtgcaaattggtttaaaacatcattttgccgtggctggggactataatttagtgttattggataacttattattaaataaaaacatggaacaagtgtattgttgtaatgaattaaattgtggtttttctgctgaaggttatgctagagctaaaggtgcagctgctgctgttgttacttattctgtgggtgctttatctgcttttgatgctattggtggtgcttatgccgaaaatttacccgtgattttaatttctggtgcccctaataataatgatcatgccgctggacatgttttacatcatgccttaggtaaaaccgattatcattatcaattagaaatggccaaaaatattactgctgctgccgaagctatttatactcctgaagaagcccctgccaaaattgatcatgtgattaaaaccgccttacgcgaaaaaaaacccgtgtatttagaaattgcctgtaatattgcttctatgccttgtgctgctcctgggcctgcttctgctttatttaatgatgaagcctctgatgaagctagtttaaatgctgccgtggaagaaaccttaaaatttattgccaatcgcgataaagttgccgtgttagttggttctaaattaagagctgctggtgctgaagaagctgctgttaaatttgctgatgctttaggtggtgcagttgctactatggctgctgccaaatctttttttcccgaagaaaatccccattatattggaactagttggggagaagtttcttatcctggtgtggaaaaaactatgaaagaagccgacgctgttattgctttagcccctgtgtttaatgattattctaccactggttggactgatattcccgatcccaaaaaattagttttagccgaacctcgttctgttgttgttaatggtgttcgctttccctctgtgcatttaaaagattatttaacccgcttagcccaaaaagtttctaaaaaaactggtgccttagatttttttaaatctttaaatgcgggtgaattaaaaaaagctgctcctgctgatccttctgctcctttagttaatgctgaaattgcccgtcaagttgaagccttattaacccctaatactaccgttattgccgaaactggtgattcttggtttaatgcccaacgcatgaaattacctaatggtgcccgtgttgaatatgaaatgcaatggggtcatattggttggtctgtacctgctgcttttggttatgctgttggtgctcctgaacgtcgtaatattttaatggtgggtgatggttcttttcaattaactgcccaagaagttgcccaaatggttcgcttaaaattacccgttattatttttttaataaataattatggttataccattgaagtgatgattcatgatgggccatataataatattaaaaattgggattatgcgggtttaatggaagtgtttaatggtaatggtggttatgattctggtgctggtaaaggtttaaaagccaaaactggtggtgaattagctgaagctattaaagttgccttagccaatactgatgggccaaccttaattgaatgttttattggtcgcgaagattgtaccgaagaattagttaaatggggtaaacgtgttgctgctgctaattctcgcaaacccgtgaataaattattgtaatttttggggatcaattcgagctcagcaagtttcatcccgaccccctcagggtcgggatttttttattgtactagttgacataagtaaaggcatcccctgcgtgatataattaccttcagtttaaggaggtatacacatatgattaaagcctatgctgccttagaagccaatggtaaattacaaccctttgaatatgatcctggtgctttaggtgccaatgaagtggaaattgaagtgcaatattgtggtgtgtgtcattctgatttatctatgattaataatgaatggggtatttctaattatcccttagttcctggtcatgaagttgttggtactgttgctgctatgggtgaaggtgttaatcatgtggaagtgggtgatttagttggtttaggttggcattctggttattgtatgacctgtcattcttgtttatctggttatcataatttatgtgccactgccgaatctactattgtgggtcattatggtggttttggtgatagagttcgtgctaaaggtgtttctgtggtgaaattacccaaaggtattgatttagcctctgctgggcctttattttgtggtggtattaccgttttttctcccatggtggaattatctttaaaacctaccgccaaagttgctgttattggtattggtggtttaggtcatttagccgttcaatttttaagagcctggggttgtgaagttactgcttttacctcttctgcccgtaaacaaaccgaagttttagaattaggtgcccatcatattttagattctaccaatcctgaagctattgcttctgccgaaggtaaatttgattatattatttctaccgtgaatttaaaattagattggaatttatatatcagtaccttagcccctcaaggtcattttcattttgttggtgtggtgttagaacccttggacttaaacttatttcccttattaatgggacaacgttctgtttctgcttctcctgttggttctcctgctactattgccactatgttagattttgccgtgcgtcatgatattaaacccgtggtggaacaattttcttttgatcaaattaatgaagccattgcccatttagaatctggtaaagcccattatcgcgtggtgttatctcattctaaaaattaataagattaacttctaaactgaaacaaatttgagggtaggcttcattgtctgcccttatttttttatttaggaaaagtgaacagactaaagagtgttggctctattgctttgagtatgtaaattaggcgttgctgaattaaggtatgatttttgaccccttctctcttctgcaggatcatcttgctgaaaaactcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgccctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttgaatatttttcgtcagatacgcaaaccttacaaacataattaacaactgaaactattgatatgtctaggttttagctctatcacaggttggatctg

SEQ ID NO: 56 - DNA, 12973 bp, Cyanobacterium sp. ABICyano1
tcgtcagatacgcaaaccttacaaacataattaacaactgaaactattgatatgtctaggttttagctctatcacaggttggatctgtcgacgggcaaactttatgaagcagatcaagcctatatccgccaagcaaccggcagccgcgttgattagtgggtgtgtccatcctctggttcgtctaggtgctccgaagcgtcacgatagagattaagaatgtggtgatccttgaggcgataaatcacattccgcccttccttgcgatagctcactaaacgtgctgtgcgcagggttcttagttggtgagagacagccgattcactcatttcaacggcggcggcgagttcccccacccgcatctctccagtggccagggccgaaagaatacgccagcggttggcatcccccaagacaccaaaaaattcggccatccgttgggccttggcttggttcaagattttgccactgtggtctgtcattgttcgctgatctaaacaatacctgaataattgttcatgtgttaatctaaaaatgtgaacaatcgttcaactatttaagacaataccttggaggtttaaaccatgaattcttataccgtgggtacttatttagccgaacgcttagtgcaaattggtttaaaacatcattttgccgtggctggggactataatttagtgttattggataacttattattaaataaaaacatggaacaagtgtattgttgtaatgaattaaattgtggtttttctgctgaaggttatgctagagctaaaggtgcagctgctgctgttgttacttattctgtgggtgctttatctgcttttgatgctattggtggtgcttatgccgaaaatttacccgtgattttaatttctggtgcccctaataataatgatcatgccgctggacatgttttacatcatgccttaggtaaaaccgattatcattatcaattagaaatggccaaaaatattactgctgctgccgaagctatttatactcctgaagaagcccctgccaaaattgatcatgtgattaaaaccgccttacgcgaaaaaaaacccgtgtatttagaaattgcctgtaatattgcttctatgccttgtgctgctcctgggcctgcttctgctttatttaatgatgaagcctctgatgaagctagtttaaatgctgccgtggaagaaaccttaaaatttattgccaatcgcgataaagttgccgtgttagttggttctaaattaagagctgctggtgctgaagaagctgctgttaaatttgctgatgctttaggtggtgcagttgctactatggctgctgccaaatctttttttcccgaagaaaatccccattatattggaactagttggggagaagtttcttatcctggtgtggaaaaaactatgaaagaagccgacgctgttattgctttagcccctgtgtttaatgattattctaccactggttggactgatattcccgatcccaaaaaattagttttagccgaacctcgttctgttgttgttaatggtgttcgctttccctctgtgcatttaaaagattatttaacccgcttagcccaaaaagtttctaaaaaaactggtgccttagatttttttaaatctttaaatgcgggtgaattaaaaaaagctgctcctgctgatccttctgctcctttagttaatgctgaaattgcccgtcaagttgaagccttattaacccctaatactaccgttattgccgaaactggtgattcttggtttaatgcccaacgcatgaaattacctaatggtgcccgtgttgaatatgaaatgcaatggggtcatattggttggtctgtacctgctgcttttggttatgctgttggtgctcctgaacgtcgtaatattttaatggtgggtgatggttcttttcaattaactgcccaagaagttgcccaaatggttcgcttaaaattacccgttattatttttttaataaataattatggttataccattgaagtgatgattcatgatgggccatataataatattaaaaattgggattatgcgggtttaatggaagtgtttaatggtaatggtggttatgattctggtgctggtaaaggtttaaaagccaaaactggtggtgaattagctgaagctattaaagttgccttagccaatactgatgggccaaccttaattgaatgttttattggtcgcgaagattgtaccgaagaattagttaaatggggtaaacgtgttgctgctgctaattctcgcaaacccgtgaataaattattgtaatttttggggatcaattcgagctcagcaagtttcatcccgaccccctcagggtcgggatttttttattgtactagttgacataagtaaaggcatcccctgcgtgatataattaccttcagtttaaggaggtatacacatatgattaaagcctatgctgccttagaagccaatggtaaattacaaccctttgaatatgatcctggtgctttaggtgccaatgaagtggaaattgaagtgcaatattgtggtgtgtgtcattctgatttatctatgattaataatgaatggggtatttctaattatcccttagttcctggtcatgaagttgttggtactgttgctgctatgggtgaaggtgttaatcatgtggaagtgggtgatttagttggtttaggttggcattctggttattgtatgacctgtcattcttgtttatctggttatcataatttatgtgccactgccgaatctactattgtgggtcattatggtggttttggtgatagagttcgtgctaaaggtgtttctgtggtgaaattacccaaaggtattgatttagcctctgctgggcctttattttgtggtggtattaccgttttttctcccatggtggaattatctttaaaacctaccgccaaagttgctgttattggtattggtggtttaggtcatttagccgttcaatttttaagagcctggggttgtgaagttactgcttttacctcttctgcccgtaaacaaaccgaagttttagaattaggtgcccatcatattttagattctaccaatcctgaagctattgcttctgccgaaggtaaatttgattatattatttctaccgtgaatttaaaattagattggaatttatatatcagtaccttagcccctcaaggtcattttcattttgttggtgtggtgttagaacccttggacttaaacttatttcccttattaatgggacaacgttctgtttctgcttctcctgttggttctcctgctactattgccactatgttagattttgccgtgcgtcatgatattaaacccgtggtggaacaattttcttttgatcaaattaatgaagccattgcccatttagaatctggtaaagcccattatcgcgtggtgttatctcattctaaaaattaataagattaacttctaaactgaaacaaatttgagggtaggcttcattgtctgcccttatttttttatttaggaaaagtgaacagactaaagagtgttggctctattgctttgagtatgtaaattaggcgttgctgaattaaggtatgatttttgaccccttctctcttctgcaggatcatcttgctgaaaaactcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgccctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttgaatatttt

SEQ ID NO: 57 - DNA, 12973 bp, Cyanobacterium sp. ABICyano1
tcgacgggcaaactttatgaagcagatcaagcctatatccgccaagcaaccggcagccgcgttgattagtgggtgtgtccatcctctggttcgtctaggtgctccgaagcgtcacgatagagattaagaatgtggtgatccttgaggcgataaatcacattccgcccttccttgcgatagctcactaaacgtgctgtgcgcagggttcttagttggtgagagacagccgattcactcatttcaacggcggcggcgagttcccccacccgcatctctccagtggccagggccgaaagaatacgccagcggttggcatcccccaagacaccaaaaaattcggccatccgttgggccttggcttggttcaagattttgccactgtggtctgtcattgttcgctgatctaaacaatacctgaataattgttcatgtgttaatctaaaaatgtgaacaatcgttcaactatttaagacaataccaaggaggtgataaccatgaattcttataccgtgggtacttatttagccgaacgcttagtgcaaattggtttaaaacatcattttgccgtggctggggactataatttagtgttattggataacttattattaaataaaaacatggaacaagtgtattgttgtaatgaattaaattgtggtttttctgctgaaggttatgctagagctaaaggtgcagctgctgctgttgttacttattctgtgggtgctttatctgcttttgatgctattggtggtgcttatgccgaaaatttacccgtgattttaatttctggtgcccctaataataatgatcatgccgctggacatgttttacatcatgccttaggtaaaaccgattatcattatcaattagaaatggccaaaaatattactgctgctgccgaagctatttatactcctgaagaagcccctgccaaaattgatcatgtgattaaaaccgccttacgcgaaaaaaaacccgtgtatttagaaattgcctgtaatattgcttctatgccttgtgctgctcctgggcctgcttctgctttatttaatgatgaagcctctgatgaagctagtttaaatgctgccgtggaagaaaccttaaaatttattgccaatcgcgataaagttgccgtgttagttggttctaaattaagagctgctggtgctgaagaagctgctgttaaatttgctgatgctttaggtggtgcagttgctactatggctgctgccaaatctttttttcccgaagaaaatccccattatattggaactagttggggagaagtttcttatcctggtgtggaaaaaactatgaaagaagccgacgctgttattgctttagcccctgtgtttaatgattattctaccactggttggactgatattcccgatcccaaaaaattagttttagccgaacctcgttctgttgttgttaatggtgttcgctttccctctgtgcatttaaaagattatttaacccgcttagcccaaaaagtttctaaaaaaactggtgccttagatttttttaaatctttaaatgcgggtgaattaaaaaaagctgctcctgctgatccttctgctcctttagttaatgctgaaattgcccgtcaagttgaagccttattaacccctaatactaccgttattgccgaaactggtgattcttggtttaatgcccaacgcatgaaattacctaatggtgcccgtgttgaatatgaaatgcaatggggtcatattggttggtctgtacctgctgcttttggttatgctgttggtgctcctgaacgtcgtaatattttaatggtgggtgatggttcttttcaattaactgcccaagaagttgcccaaatggttcgcttaaaattacccgttattatttttttaataaataattatggttataccattgaagtgatgattcatgatgggccatataataatattaaaaattgggattatgcgggtttaatggaagtgtttaatggtaatggtggttatgattctggtgctggtaaaggtttaaaagccaaaactggtggtgaattagctgaagctattaaagttgccttagccaatactgatgggccaaccttaattgaatgttttattggtcgcgaagattgtaccgaagaattagttaaatggggtaaacgtgttgctgctgctaattctcgcaaacccgtgaataaattattgtaatttttggggatcaattcgagctcagcaagtttcatcccgaccccctcagggtcgggatttttttattgtactagttgacataagtaaaggcatcccctgcgtgatataattaccttcagtttaaggaggtatacacatatgattaaagcctatgctgccttagaagccaatggtaaattacaaccctttgaatatgatcctggtgctttaggtgccaatgaagtggaaattgaagtgcaatattgtggtgtgtgtcattctgatttatctatgattaataatgaatggggtatttctaattatcccttagttcctggtcatgaagttgttggtactgttgctgctatgggtgaaggtgttaatcatgtggaagtgggtgatttagttggtttaggttggcattctggttattgtatgacctgtcattcttgtttatctggttatcataatttatgtgccactgccgaatctactattgtgggtcattatggtggttttggtgatagagttcgtgctaaaggtgtttctgtggtgaaattacccaaaggtattgatttagcctctgctgggcctttattttgtggtggtattaccgttttttctcccatggtggaattatctttaaaacctaccgccaaagttgctgttattggtattggtggtttaggtcatttagccgttcaatttttaagagcctggggttgtgaagttactgcttttacctcttctgcccgtaaacaaaccgaagttttagaattaggtgcccatcatattttagattctaccaatcctgaagctattgcttctgccgaaggtaaatttgattatattatttctaccgtgaatttaaaattagattggaatttatatatcagtaccttagcccctcaaggtcattttcattttgttggtgtggtgttagaacccttggacttaaacttatttcccttattaatgggacaacgttctgtttctgcttctcctgttggttctcctgctactattgccactatgttagattttgccgtgcgtcatgatattaaacccgtggtggaacaattttcttttgatcaaattaatgaagccattgcccatttagaatctggtaaagcccattatcgcgtggtgttatctcattctaaaaattaataagattaacttctaaactgaaacaaatttgagggtaggcttcattgtctgcccttatttttttatttaggaaaagtgaacagactaaagagtgttggctctattgctttgagtatgtaaattaggcgttgctgaattaaggtatgatttttgaccccttctctcttctgcaggatcatcttgctgaaaaactcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgccctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttgaatatttttcgtcagatacgcaaaccttacaaacataattaacaactgaaactattgatatgtctaggttttagctctatcacaggttggatctg

SEQ ID NO: 58 - DNA, 12973 bp, Cyanobacterium sp. ABICyano1
tcgacgggcaaactttatgaagcagatcaagcctatatccgccaagcaaccggcagccgcgttgattagtgggtgtgtccatcctctggttcgtctaggtgctccgaagcgtcacgatagagattaagaatgtggtgatccttgaggcgataaatcacattccgcccttccttgcgatagctcactaaacgtgctgtgcgcagggttcttagttggtgagagacagccgattcactcatttcaacggcggcggcgagttcccccacccgcatctctccagtggccagggccgaaagaatacgccagcggttggcatcccccaagacaccaaaaaattcggccatccgttgggccttggcttggttcaagattttgccactgtggtctgtcattgttcgctgatctaaacaatacctgaataattgttcatgtgttaatctaaaaatgtgaacaatcgttcaactatttaagacaataccaaggaggtataaaccatgaattcttataccgtgggtacttatttagccgaacgcttagtgcaaattggtttaaaacatcattttgccgtggctggggactataatttagtgttattggataacttattattaaataaaaacatggaacaagtgtattgttgtaatgaattaaattgtggtttttctgctgaaggttatgctagagctaaaggtgcagctgctgctgttgttacttattctgtgggtgctttatctgcttttgatgctattggtggtgcttatgccgaaaatttacccgtgattttaatttctggtgcccctaataataatgatcatgccgctggacatgttttacatcatgccttaggtaaaaccgattatcattatcaattagaaatggccaaaaatattactgctgctgccgaagctatttatactcctgaagaagcccctgccaaaattgatcatgtgattaaaaccgccttacgcgaaaaaaaacccgtgtatttagaaattgcctgtaatattgcttctatgccttgtgctgctcctgggcctgcttctgctttatttaatgatgaagcctctgatgaagctagtttaaatgctgccgtggaagaaaccttaaaatttattgccaatcgcgataaagttgccgtgttagttggttctaaattaagagctgctggtgctgaagaagctgctgttaaatttgctgatgctttaggtggtgcagttgctactatggctgctgccaaatctttttttcccgaagaaaatccccattatattggaactagttggggagaagtttcttatcctggtgtggaaaaaactatgaaagaagccgacgctgttattgctttagcccctgtgtttaatgattattctaccactggttggactgatattcccgatcccaaaaaattagttttagccgaacctcgttctgttgttgttaatggtgttcgctttccctctgtgcatttaaaagattatttaacccgcttagcccaaaaagtttctaaaaaaactggtgccttagatttttttaaatctttaaatgcgggtgaattaaaaaaagctgctcctgctgatccttctgctcctttagttaatgctgaaattgcccgtcaagttgaagccttattaacccctaatactaccgttattgccgaaactggtgattcttggtttaatgcccaacgcatgaaattacctaatggtgcccgtgttgaatatgaaatgcaatggggtcatattggttggtctgtacctgctgcttttggttatgctgttggtgctcctgaacgtcgtaatattttaatggtgggtgatggttcttttcaattaactgcccaagaagttgcccaaatggttcgcttaaaattacccgttattatttttttaataaataattatggttataccattgaagtgatgattcatgatgggccatataataatattaaaaattgggattatgcgggtttaatggaagtgtttaatggtaatggtggttatgattctggtgctggtaaaggtttaaaagccaaaactggtggtgaattagctgaagctattaaagttgccttagccaatactgatgggccaaccttaattgaatgttttattggtcgcgaagattgtaccgaagaattagttaaatggggtaaacgtgttgctgctgctaattctcgcaaacccgtgaataaattattgtaatttttggggatcaattcgagctcagcaagtttcatcccgaccccctcagggtcgggatttttttattgtactagttgacataagtaaaggcatcccctgcgtgatataattaccttcagtttaaggaggtatacacatatgattaaagcctatgctgccttagaagccaatggtaaattacaaccctttgaatatgatcctggtgctttaggtgccaatgaagtggaaattgaagtgcaatattgtggtgtgtgtcattctgatttatctatgattaataatgaatggggtatttctaattatcccttagttcctggtcatgaagttgttggtactgttgctgctatgggtgaaggtgttaatcatgtggaagtgggtgatttagttggtttaggttggcattctggttattgtatgacctgtcattcttgtttatctggttatcataatttatgtgccactgccgaatctactattgtgggtcattatggtggttttggtgatagagttcgtgctaaaggtgtttctgtggtgaaattacccaaaggtattgatttagcctctgctgggcctttattttgtggtggtattaccgttttttctcccatggtggaattatctttaaaacctaccgccaaagttgctgttattggtattggtggtttaggtcatttagccgttcaatttttaagagcctggggttgtgaagttactgcttttacctcttctgcccgtaaacaaaccgaagttttagaattaggtgcccatcatattttagattctaccaatcctgaagctattgcttctgccgaaggtaaatttgattatattatttctaccgtgaatttaaaattagattggaatttatatatcagtaccttagcccctcaaggtcattttcattttgttggtgtggtgttagaacccttggacttaaacttatttcccttattaatgggacaacgttctgtttctgcttctcctgttggttctcctgctactattgccactatgttagattttgccgtgcgtcatgatattaaacccgtggtggaacaattttcttttgatcaaattaatgaagccattgcccatttagaatctggtaaagcccattatcgcgtggtgttatctcattctaaaaattaataagattaacttctaaactgaaacaaatttgagggtaggcttcattgtctgcccttatttttttatttaggaaaagtgaacagactaaagagtgttggctctattgctttgagtatgtaaattaggcgttgctgaattaaggtatgatttttgaccccttctctcttctgcaggatcatcttgctgaaaaactcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgccctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttgaatatttttcgtcagatacgcaaaccttacaaacataattaacaactgaaactattgatatgtctaggttttagctctatcacaggttggatctg

SEQ ID NO: 59 - DNA, 12762 bp, Cyanobacterium sp. ABICyano1
tcgacaattaataacttcttcctgtacgggcgaatggccatttgctcctaactaactccgtactgctttgcggaacgagcgtagcgaactctccgaattactaagccttcatccctgatagatgcaaaaaacgaattaaaattatgtgtaaaaagaaaatgtgtctttatttagtagtcaaagttacaaaatattaagaatcaaattaataatgtattgggcagttaagtatataagtctttaaatatttatttgtattcaatatattaaccgaggacaaattatgaattcttataccgtgggtacttatttagccgaacgcttagtgcaaattggtttaaaacatcattttgccgtggctggggactataatttagtgttattggataacttattattaaataaaaacatggaacaagtgtattgttgtaatgaattaaattgtggtttttctgctgaaggttatgctagagctaaaggtgcagctgctgctgttgttacttattctgtgggtgctttatctgcttttgatgctattggtggtgcttatgccgaaaatttacccgtgattttaatttctggtgcccctaataataatgatcatgccgctggacatgttttacatcatgccttaggtaaaaccgattatcattatcaattagaaatggccaaaaatattactgctgctgccgaagctatttatactcctgaagaagcccctgccaaaattgatcatgtgattaaaaccgccttacgcgaaaaaaaacccgtgtatttagaaattgcctgtaatattgcttctatgccttgtgctgctcctgggcctgcttctgctttatttaatgatgaagcctctgatgaagctagtttaaatgctgccgtggaagaaaccttaaaatttattgccaatcgcgataaagttgccgtgttagttggttctaaattaagagctgctggtgctgaagaagctgctgttaaatttgctgatgctttaggtggtgcagttgctactatggctgctgccaaatctttttttcccgaagaaaatccccattatattggaactagttggggagaagtttcttatcctggtgtggaaaaaactatgaaagaagccgacgctgttattgctttagcccctgtgtttaatgattattctaccactggttggactgatattcccgatcccaaaaaattagttttagccgaacctcgttctgttgttgttaatggtgttcgctttccctctgtgcatttaaaagattatttaacccgcttagcccaaaaagtttctaaaaaaactggtgccttagatttttttaaatctttaaatgcgggtgaattaaaaaaagctgctcctgctgatccttctgctcctttagttaatgctgaaattgcccgtcaagttgaagccttattaacccctaatactaccgttattgccgaaactggtgattcttggtttaatgcccaacgcatgaaattacctaatggtgcccgtgttgaatatgaaatgcaatggggtcatattggttggtctgtacctgctgcttttggttatgctgttggtgctcctgaacgtcgtaatattttaatggtgggtgatggttcttttcaattaactgcccaagaagttgcccaaatggttcgcttaaaattacccgttattatttttttaataaataattatggttataccattgaagtgatgattcatgatgggccatataataatattaaaaattgggattatgcgggtttaatggaagtgtttaatggtaatggtggttatgattctggtgctggtaaaggtttaaaagccaaaactggtggtgaattagctgaagctattaaagttgccttagccaatactgatgggccaaccttaattgaatgttttattggtcgcgaagattgtaccgaagaattagttaaatggggtaaacgtgttgctgctgctaattctcgcaaacccgtgaataaattattgtaatttttggggatcaattcgagctcagcaagtttcatcccgaccccctcagggtcgggatttttttattgtactagttgacataagtaaaggcatcccctgcgtgatataattaccttcagtttaaggaggtatacacatatgattaaagcctatgctgccttagaagccaatggtaaattacaaccctttgaatatgatcctggtgctttaggtgccaatgaagtggaaattgaagtgcaatattgtggtgtgtgtcattctgatttatctatgattaataatgaatggggtatttctaattatcccttagttcctggtcatgaagttgttggtactgttgctgctatgggtgaaggtgttaatcatgtggaagtgggtgatttagttggtttaggttggcattctggttattgtatgacctgtcattcttgtttatctggttatcataatttatgtgccactgccgaatctactattgtgggtcattatggtggttttggtgatagagttcgtgctaaaggtgtttctgtggtgaaattacccaaaggtattgatttagcctctgctgggcctttattttgtggtggtattaccgttttttctcccatggtggaattatctttaaaacctaccgccaaagttgctgttattggtattggtggtttaggtcatttagccgttcaatttttaagagcctggggttgtgaagttactgcttttacctcttctgcccgtaaacaaaccgaagttttagaattaggtgcccatcatattttagattctaccaatcctgaagctattgcttctgccgaaggtaaatttgattatattatttctaccgtgaatttaaaattagattggaatttatatatcagtaccttagcccctcaaggtcattttcattttgttggtgtggtgttagaacccttggacttaaacttatttcccttattaatgggacaacgttctgtttctgcttctcctgttggttctcctgctactattgccactatgttagattttgccgtgcgtcatgatattaaacccgtggtggaacaattttcttttgatcaaattaatgaagccattgcccatttagaatctggtaaagcccattatcgcgtggtgttatctcattctaaaaattaataagattaacttctaaactgaaacaaatttgagggtaggcttcattgtctgcccttatttttttatttaggaaaagtgaacagactaaagagtgttggctctattgctttgagtatgtaaattaggcgttgctgaattaaggtatgatttttgaccccttctctcttctgcaggatcatcttgctgaaaaactcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgccctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttgaatatttttcgtcagatacgcaaaccttacaaacataattaacaactgaaactattgatatgtctaggttttagctctatcacaggttggatctg

SEQ ID NO: 60 - DNA, 12938 bp, Cyanobacterium sp. ABICyano1
tcgacattctgtgaattgattagatttgaggttttttaagaggttgattaccttgcctccaaaaaaatcataacacactaatgctctatatgaaagggctttagacccataggtttttgagaaaaaaacttgctaactctcggacaatgtcagcataactaaagtcaattcttttcgtactttataattgtctataatttaatatacaactgttctgaaactagtttttctctacattccttagttttatctgagtaaggttgcttgtaacttaacttcggttgggcctaaaaatatccgattaggagcaggtgtcagactttaattaattattaattattaattgcttattgccaaccctcggcgacaccactttttcatcagccccagataaagattgatgttttagttttgtttctttttatcccctaattcaactaatacaagtaaaactaaggttgtttatcaaaaatgatggttgatgtttgggtaaattttaagatattatgaaaagaaaatgaataaaaaatgaaaaatctttatgaattcttataccgtgggtacttatttagccgaacgcttagtgcaaattggtttaaaacatcattttgccgtggctggggactataatttagtgttattggataacttattattaaataaaaacatggaacaagtgtattgttgtaatgaattaaattgtggtttttctgctgaaggttatgctagagctaaaggtgcagctgctgctgttgttacttattctgtgggtgctttatctgcttttgatgctattggtggtgcttatgccgaaaatttacccgtgattttaatttctggtgcccctaataataatgatcatgccgctggacatgttttacatcatgccttaggtaaaaccgattatcattatcaattagaaatggccaaaaatattactgctgctgccgaagctatttatactcctgaagaagcccctgccaaaattgatcatgtgattaaaaccgccttacgcgaaaaaaaacccgtgtatttagaaattgcctgtaatattgcttctatgccttgtgctgctcctgggcctgcttctgctttatttaatgatgaagcctctgatgaagctagtttaaatgctgccgtggaagaaaccttaaaatttattgccaatcgcgataaagttgccgtgttagttggttctaaattaagagctgctggtgctgaagaagctgctgttaaatttgctgatgctttaggtggtgcagttgctactatggctgctgccaaatctttttttcccgaagaaaatccccattatattggaactagttggggagaagtttcttatcctggtgtggaaaaaactatgaaagaagccgacgctgttattgctttagcccctgtgtttaatgattattctaccactggttggactgatattcccgatcccaaaaaattagttttagccgaacctcgttctgttgttgttaatggtgttcgctttccctctgtgcatttaaaagattatttaacccgcttagcccaaaaagtttctaaaaaaactggtgccttagatttttttaaatctttaaatgcgggtgaattaaaaaaagctgctcctgctgatccttctgctcctttagttaatgctgaaattgcccgtcaagttgaagccttattaacccctaatactaccgttattgccgaaactggtgattcttggtttaatgcccaacgcatgaaattacctaatggtgcccgtgttgaatatgaaatgcaatggggtcatattggttggtctgtacctgctgcttttggttatgctgttggtgctcctgaacgtcgtaatattttaatggtgggtgatggttcttttcaattaactgcccaagaagttgcccaaatggttcgcttaaaattacccgttattatttttttaataaataattatggttataccattgaagtgatgattcatgatgggccatataataatattaaaaattgggattatgcgggtttaatggaagtgtttaatggtaatggtggttatgattctggtgctggtaaaggtttaaaagccaaaactggtggtgaattagctgaagctattaaagttgccttagccaatactgatgggccaaccttaattgaatgttttattggtcgcgaagattgtaccgaagaattagttaaatggggtaaacgtgttgctgctgctaattctcgcaaacccgtgaataaattattgtaatttttggggatcaattcgagctcagcaagtttcatcccgaccccctcagggtcgggatttttttattgtactagttgacataagtaaaggcatcccctgcgtgatataattaccttcagtttaaggaggtatacacatatgagtgaaactaaatttaaagcctatgccgtaatgaatcctggtgaaaaattacaaccctgggaatatgaacctgctcctttacaggtagatgaaattgaagtaagagttactcacaatggtttatgtcacactgacttacacatgagagataatgactggaatgttagtgagttccccttagtagcaggtcatgaagttgttggtgaagtaaccgctgttggtgaaaaagtaaccagtcgtaaaaaaggtgatagagttggtgtaggttggattcgtaattcttgtcgcgcttgtgaccattgtttacaaggagaagagaacatttgtagagagggttatactggtttaattgttggtcatcacggtggatttgctgatcgtgtacgtgtacctgctgacttcacttataaaattcctgatgctttagatagtgcatctgctgctcctttattatgtgccggtattaccgtttacactcctttaagaacctacattaaacatcccggtatgaaagtaggtgttatgggtattggaggattaggacatttagctattaaatttgctcgtgcaatgggagcagaagttactgcctttagtaccagtcctaataaagaagcccaagccaaagaatttggtgctcatcatttccaacaatggggtactgctgaagaaatgaaagctgttgccggtaattttgatttagttttatctaccatctctgctgaaactgactgggatgctgccttctctttattagcaaataacggtgttttatgtttcgtaggtattcccgttagttctttaaatgttcctttaattcctttaattttcggacaaaaatctgttgtaggttctgtagttggaggaagaagattcatggcagaaatgttagagttcgccgctgtaaatcagattaaacctatgatcgaaactatgcccttatctcaagtaaatgaagctatggataaagttgccgccaataaagccagatatagaattgtattattatctgaataactagatctcctgcagagaatataaaaagccagattattaatccggcttttttattatttaaatactgtgcacgatcctgcaggatcatcttgctgaaaaactcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgccctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttgaatatttttcgtcagatacgcaaaccttacaaacataattaacaactgaaactattgatatgtctaggttttagctctatcacaggttggatctg

SEQ ID NO: 61 - DNA, 12722 bp, Cyanobacterium sp. ABICyano1
tcgacgaatatctcatccttagcttctacttataccttcagcatagttaaaaatcatccctttattgatggtaataaaagaacaggttttattagtggagtaacctttttaatgctcaatggttctcactttactgcttctgaagtggaagtagtacatatcatccaaaccttagctagtggcagaattaccgaggaagaattacaacaatggttcgtaaggaaaagtaagcagatgaataattaaagcatcatttcatcctcatttcatattctcctgtcaccatggtatggaagattaggtaaaaatgaggaaaaagtttattatgaattcttataccgtgggtacttatttagccgaacgcttagtgcaaattggtttaaaacatcattttgccgtggctggggactataatttagtgttattggataacttattattaaataaaaacatggaacaagtgtattgttgtaatgaattaaattgtggtttttctgctgaaggttatgctagagctaaaggtgcagctgctgctgttgttacttattctgtgggtgctttatctgcttttgatgctattggtggtgcttatgccgaaaatttacccgtgattttaatttctggtgcccctaataataatgatcatgccgctggacatgttttacatcatgccttaggtaaaaccgattatcattatcaattagaaatggccaaaaatattactgctgctgccgaagctatttatactcctgaagaagcccctgccaaaattgatcatgtgattaaaaccgccttacgcgaaaaaaaacccgtgtatttagaaattgcctgtaatattgcttctatgccttgtgctgctcctgggcctgcttctgctttatttaatgatgaagcctctgatgaagctagtttaaatgctgccgtggaagaaaccttaaaatttattgccaatcgcgataaagttgccgtgttagttggttctaaattaagagctgctggtgctgaagaagctgctgttaaatttgctgatgctttaggtggtgcagttgctactatggctgctgccaaatctttttttcccgaagaaaatccccattatattggaactagttggggagaagtttcttatcctggtgtggaaaaaactatgaaagaagccgacgctgttattgctttagcccctgtgtttaatgattattctaccactggttggactgatattcccgatcccaaaaaattagttttagccgaacctcgttctgttgttgttaatggtgttcgctttccctctgtgcatttaaaagattatttaacccgcttagcccaaaaagtttctaaaaaaactggtgccttagatttttttaaatctttaaatgcgggtgaattaaaaaaagctgctcctgctgatccttctgctcctttagttaatgctgaaattgcccgtcaagttgaagccttattaacccctaatactaccgttattgccgaaactggtgattcttggtttaatgcccaacgcatgaaattacctaatggtgcccgtgttgaatatgaaatgcaatggggtcatattggttggtctgtacctgctgcttttggttatgctgttggtgctcctgaacgtcgtaatattttaatggtgggtgatggttcttttcaattaactgcccaagaagttgcccaaatggttcgcttaaaattacccgttattatttttttaataaataattatggttataccattgaagtgatgattcatgatgggccatataataatattaaaaattgggattatgcgggtttaatggaagtgtttaatggtaatggtggttatgattctggtgctggtaaaggtttaaaagccaaaactggtggtgaattagctgaagctattaaagttgccttagccaatactgatgggccaaccttaattgaatgttttattggtcgcgaagattgtaccgaagaattagttaaatggggtaaacgtgttgctgctgctaattctcgcaaacccgtgaataaattattgtaatttttggggatcaattcgagctcagcaagtttcatcccgaccccctcagggtcgggatttttttattgtactagttgacataagtaaaggcatcccctgcgtgatataattaccttcagtttaaggaggtatacacatatgagtgaaactaaatttaaagcctatgccgtaatgaatcctggtgaaaaattacaaccctgggaatatgaacctgctcctttacaggtagatgaaattgaagtaagagttactcacaatggtttatgtcacactgacttacacatgagagataatgactggaatgttagtgagttccccttagtagcaggtcatgaagttgttggtgaagtaaccgctgttggtgaaaaagtaaccagtcgtaaaaaaggtgatagagttggtgtaggttggattcgtaattcttgtcgcgcttgtgaccattgtttacaaggagaagagaacatttgtagagagggttatactggtttaattgttggtcatcacggtggatttgctgatcgtgtacgtgtacctgctgacttcacttataaaattcctgatgctttagatagtgcatctgctgctcctttattatgtgccggtattaccgtttacactcctttaagaacctacattaaacatcccggtatgaaagtaggtgttatgggtattggaggattaggacatttagctattaaatttgctcgtgcaatgggagcagaagttactgcctttagtaccagtcctaataaagaagcccaagccaaagaatttggtgctcatcatttccaacaatggggtactgctgaagaaatgaaagctgttgccggtaattttgatttagttttatctaccatctctgctgaaactgactgggatgctgccttctctttattagcaaataacggtgttttatgtttcgtaggtattcccgttagttctttaaatgttcctttaattcctttaattttcggacaaaaatctgttgtaggttctgtagttggaggaagaagattcatggcagaaatgttagagttcgccgctgtaaatcagattaaacctatgatcgaaactatgcccttatctcaagtaaatgaagctatggataaagttgccgccaataaagccagatatagaattgtattattatctgaataactagatctcctgcagagaatataaaaagccagattattaatccggcttttttattatttaaatactgtgcacgatcctgcaggatcatcttgctgaaaaactcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgccctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttgaatatttttcgtcagatacgcaaaccttacaaacataattaacaactgaaactattgatatgtctaggttttagctctatcacaggttggatctg

SEQ ID NO: 62 - DNA, 12732 bp, Cyanobacterium sp. ABICyano1
tcgactggtcaagttactatatgtttagaaacaacaaaaaaagaagtcattataaaaataattgatacaggaattggcattaataaagaagaacaaaaattaatttttaatcgtttttatcgaatcaataaagcaagaaatagagagaaaggcagttgcggattaggtttagctattgcaaatgcgatcgcgcttaatcatggtggtagaataattttagaaagtcaagaaaatcaaggcagtatttttaccgtttatttaccgaaaatcatttcatcctaatttcatattcttttgacagaatcaaaggtaaagataaaaagagagaaacagtcatgaattcttataccgtgggtacttatttagccgaacgcttagtgcaaattggtttaaaacatcattttgccgtggctggggactataatttagtgttattggataacttattattaaataaaaacatggaacaagtgtattgttgtaatgaattaaattgtggtttttctgctgaaggttatgctagagctaaaggtgcagctgctgctgttgttacttattctgtgggtgctttatctgcttttgatgctattggtggtgcttatgccgaaaatttacccgtgattttaatttctggtgcccctaataataatgatcatgccgctggacatgttttacatcatgccttaggtaaaaccgattatcattatcaattagaaatggccaaaaatattactgctgctgccgaagctatttatactcctgaagaagcccctgccaaaattgatcatgtgattaaaaccgccttacgcgaaaaaaaacccgtgtatttagaaattgcctgtaatattgcttctatgccttgtgctgctcctgggcctgcttctgctttatttaatgatgaagcctctgatgaagctagtttaaatgctgccgtggaagaaaccttaaaatttattgccaatcgcgataaagttgccgtgttagttggttctaaattaagagctgctggtgctgaagaagctgctgttaaatttgctgatgctttaggtggtgcagttgctactatggctgctgccaaatctttttttcccgaagaaaatccccattatattggaactagttggggagaagtttcttatcctggtgtggaaaaaactatgaaagaagccgacgctgttattgctttagcccctgtgtttaatgattattctaccactggttggactgatattcccgatcccaaaaaattagttttagccgaacctcgttctgttgttgttaatggtgttcgctttccctctgtgcatttaaaagattatttaacccgcttagcccaaaaagtttctaaaaaaactggtgccttagatttttttaaatctttaaatgcgggtgaattaaaaaaagctgctcctgctgatccttctgctcctttagttaatgctgaaattgcccgtcaagttgaagccttattaacccctaatactaccgttattgccgaaactggtgattcttggtttaatgcccaacgcatgaaattacctaatggtgcccgtgttgaatatgaaatgcaatggggtcatattggttggtctgtacctgctgcttttggttatgctgttggtgctcctgaacgtcgtaatattttaatggtgggtgatggttcttttcaattaactgcccaagaagttgcccaaatggttcgcttaaaattacccgttattatttttttaataaataattatggttataccattgaagtgatgattcatgatgggccatataataatattaaaaattgggattatgcgggtttaatggaagtgtttaatggtaatggtggttatgattctggtgctggtaaaggtttaaaagccaaaactggtggtgaattagctgaagctattaaagttgccttagccaatactgatgggccaaccttaattgaatgttttattggtcgcgaagattgtaccgaagaattagttaaatggggtaaacgtgttgctgctgctaattctcgcaaacccgtgaataaattattgtaatttttggggatcaattcgagctcagcaagtttcatcccgaccccctcagggtcgggatttttttattgtactagttgacataagtaaaggcatcccctgcgtgatataattaccttcagtttaaggaggtatacacatatgagtgaaactaaatttaaagcctatgccgtaatgaatcctggtgaaaaattacaaccctgggaatatgaacctgctcctttacaggtagatgaaattgaagtaagagttactcacaatggtttatgtcacactgacttacacatgagagataatgactggaatgttagtgagttccccttagtagcaggtcatgaagttgttggtgaagtaaccgctgttggtgaaaaagtaaccagtcgtaaaaaaggtgatagagttggtgtaggttggattcgtaattcttgtcgcgcttgtgaccattgtttacaaggagaagagaacatttgtagagagggttatactggtttaattgttggtcatcacggtggatttgctgatcgtgtacgtgtacctgctgacttcacttataaaattcctgatgctttagatagtgcatctgctgctcctttattatgtgccggtattaccgtttacactcctttaagaacctacattaaacatcccggtatgaaagtaggtgttatgggtattggaggattaggacatttagctattaaatttgctcgtgcaatgggagcagaagttactgcctttagtaccagtcctaataaagaagcccaagccaaagaatttggtgctcatcatttccaacaatggggtactgctgaagaaatgaaagctgttgccggtaattttgatttagttttatctaccatctctgctgaaactgactgggatgctgccttctctttattagcaaataacggtgttttatgtttcgtaggtattcccgttagttctttaaatgttcctttaattcctttaattttcggacaaaaatctgttgtaggttctgtagttggaggaagaagattcatggcagaaatgttagagttcgccgctgtaaatcagattaaacctatgatcgaaactatgcccttatctcaagtaaatgaagctatggataaagttgccgccaataaagccagatatagaattgtattattatctgaataactagatctcctgcagagaatataaaaagccagattattaatccggcttttttattatttaaatactgtgcacgatcctgcaggatcatcttgctgaaaaactcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgccctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttgaatatttttcgtcagatacgcaaaccttacaaacataattaacaactgaaactattgatatgtctaggttttagctctatcacaggttggatctg

SEQ ID NO: 63 - DNA, 12766 bp, Cyanobacterium sp. ABICyano1
tcgacaaagattattttctacagaagcaaccctttcatcttccgaattttcaggaatttcctgcttttgtttctgaatattagcataggcggcttttgcccactctaaagaaggttgagactgaatttctgaggtttcagaaggagcattagattgtttatcttcaacaacaggaggtttttgttcaatattttccttattctcttttttacggcgaaaccaattaaacataatgattgtgcataaatattcgttaatatattgtaaccctagaaaggaatcggtttcaggtttatccccagagaatgtgaacctttacagaaagtaaaaagtctaaaatcgtagcaacaataaatcacagaaattgagatgaattcttataccgtgggtacttatttagccgaacgcttagtgcaaattggtttaaaacatcattttgccgtggctggggactataatttagtgttattggataacttattattaaataaaaacatggaacaagtgtattgttgtaatgaattaaattgtggtttttctgctgaaggttatgctagagctaaaggtgcagctgctgctgttgttacttattctgtgggtgctttatctgcttttgatgctattggtggtgcttatgccgaaaatttacccgtgattttaatttctggtgcccctaataataatgatcatgccgctggacatgttttacatcatgccttaggtaaaaccgattatcattatcaattagaaatggccaaaaatattactgctgctgccgaagctatttatactcctgaagaagcccctgccaaaattgatcatgtgattaaaaccgccttacgcgaaaaaaaacccgtgtatttagaaattgcctgtaatattgcttctatgccttgtgctgctcctgggcctgcttctgctttatttaatgatgaagcctctgatgaagctagtttaaatgctgccgtggaagaaaccttaaaatttattgccaatcgcgataaagttgccgtgttagttggttctaaattaagagctgctggtgctgaagaagctgctgttaaatttgctgatgctttaggtggtgcagttgctactatggctgctgccaaatctttttttcccgaagaaaatccccattatattggaactagttggggagaagtttcttatcctggtgtggaaaaaactatgaaagaagccgacgctgttattgctttagcccctgtgtttaatgattattctaccactggttggactgatattcccgatcccaaaaaattagttttagccgaacctcgttctgttgttgttaatggtgttcgctttccctctgtgcatttaaaagattatttaacccgcttagcccaaaaagtttctaaaaaaactggtgccttagatttttttaaatctttaaatgcgggtgaattaaaaaaagctgctcctgctgatccttctgctcctttagttaatgctgaaattgcccgtcaagttgaagccttattaacccctaatactaccgttattgccgaaactggtgattcttggtttaatgcccaacgcatgaaattacctaatggtgcccgtgttgaatatgaaatgcaatggggtcatattggttggtctgtacctgctgcttttggttatgctgttggtgctcctgaacgtcgtaatattttaatggtgggtgatggttcttttcaattaactgcccaagaagttgcccaaatggttcgcttaaaattacccgttattatttttttaataaataattatggttataccattgaagtgatgattcatgatgggccatataataatattaaaaattgggattatgcgggtttaatggaagtgtttaatggtaatggtggttatgattctggtgctggtaaaggtttaaaagccaaaactggtggtgaattagctgaagctattaaagttgccttagccaatactgatgggccaaccttaattgaatgttttattggtcgcgaagattgtaccgaagaattagttaaatggggtaaacgtgttgctgctgctaattctcgcaaacccgtgaataaattattgtaatttttggggatcaattcgagctcagcaagtttcatcccgaccccctcagggtcgggatttttttattgtactagttgacataagtaaaggcatcccctgcgtgatataattaccttcagtttaaggaggtatacacatatgagtgaaactaaatttaaagcctatgccgtaatgaatcctggtgaaaaattacaaccctgggaatatgaacctgctcctttacaggtagatgaaattgaagtaagagttactcacaatggtttatgtcacactgacttacacatgagagataatgactggaatgttagtgagttccccttagtagcaggtcatgaagttgttggtgaagtaaccgctgttggtgaaaaagtaaccagtcgtaaaaaaggtgatagagttggtgtaggttggattcgtaattcttgtcgcgcttgtgaccattgtttacaaggagaagagaacatttgtagagagggttatactggtttaattgttggtcatcacggtggatttgctgatcgtgtacgtgtacctgctgacttcacttataaaattcctgatgctttagatagtgcatctgctgctcctttattatgtgccggtattaccgtttacactcctttaagaacctacattaaacatcccggtatgaaagtaggtgttatgggtattggaggattaggacatttagctattaaatttgctcgtgcaatgggagcagaagttactgcctttagtaccagtcctaataaagaagcccaagccaaagaatttggtgctcatcatttccaacaatggggtactgctgaagaaatgaaagctgttgccggtaattttgatttagttttatctaccatctctgctgaaactgactgggatgctgccttctctttattagcaaataacggtgttttatgtttcgtaggtattcccgttagttctttaaatgttcctttaattcctttaattttcggacaaaaatctgttgtaggttctgtagttggaggaagaagattcatggcagaaatgttagagttcgccgctgtaaatcagattaaacctatgatcgaaactatgcccttatctcaagtaaatgaagctatggataaagttgccgccaataaagccagatatagaattgtattattatctgaataactagatctcctgcagagaatataaaaagccagattattaatccggcttttttattatttaaatactgtgcacgatcctgcaggatcatcttgctgaaaaactcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgccctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttgaatatttttcgtcagatacgcaaaccttacaaacataattaacaactgaaactattgatatgtctaggttttagctctatcacaggttggatctg

SEQ ID NO: 64 - DNA, 12814 bp, Cyanobacterium sp. ABICyano1
tcgactaatatagtgattattataaatgcaatgtgaatcaaacctatattttaccgtacattgaccatggaacttaatttgaggtgattagtagagggtgcgatcgccctatttgtcaaataataaagataacatttgacattgctgattgaagacataaaacacagaaaaaatcaggtaaaaatataaagctaaagtctaaatatggtttacttttgccttcgacttacaacaaaaaatcatagctagaatcaccaacgcctaatattttatttagctgaaattttgggatgaactttttgtaaaaatcgggggtctaaaaatatagcaaccacgatattaaataactgagtgattattttaatctattgggggcttattaactaaatacttgcatttttatggagggttttaattatgaattcttataccgtgggtacttatttagccgaacgcttagtgcaaattggtttaaaacatcattttgccgtggctggggactataatttagtgttattggataacttattattaaataaaaacatggaacaagtgtattgttgtaatgaattaaattgtggtttttctgctgaaggttatgctagagctaaaggtgcagctgctgctgttgttacttattctgtgggtgctttatctgcttttgatgctattggtggtgcttatgccgaaaatttacccgtgattttaatttctggtgcccctaataataatgatcatgccgctggacatgttttacatcatgccttaggtaaaaccgattatcattatcaattagaaatggccaaaaatattactgctgctgccgaagctatttatactcctgaagaagcccctgccaaaattgatcatgtgattaaaaccgccttacgcgaaaaaaaacccgtgtatttagaaattgcctgtaatattgcttctatgccttgtgctgctcctgggcctgcttctgctttatttaatgatgaagcctctgatgaagctagtttaaatgctgccgtggaagaaaccttaaaatttattgccaatcgcgataaagttgccgtgttagttggttctaaattaagagctgctggtgctgaagaagctgctgttaaatttgctgatgctttaggtggtgcagttgctactatggctgctgccaaatctttttttcccgaagaaaatccccattatattggaactagttggggagaagtttcttatcctggtgtggaaaaaactatgaaagaagccgacgctgttattgctttagcccctgtgtttaatgattattctaccactggttggactgatattcccgatcccaaaaaattagttttagccgaacctcgttctgttgttgttaatggtgttcgctttccctctgtgcatttaaaagattatttaacccgcttagcccaaaaagtttctaaaaaaactggtgccttagatttttttaaatctttaaatgcgggtgaattaaaaaaagctgctcctgctgatccttctgctcctttagttaatgctgaaattgcccgtcaagttgaagccttattaacccctaatactaccgttattgccgaaactggtgattcttggtttaatgcccaacgcatgaaattacctaatggtgcccgtgttgaatatgaaatgcaatggggtcatattggttggtctgtacctgctgcttttggttatgctgttggtgctcctgaacgtcgtaatattttaatggtgggtgatggttcttttcaattaactgcccaagaagttgcccaaatggttcgcttaaaattacccgttattatttttttaataaataattatggttataccattgaagtgatgattcatgatgggccatataataatattaaaaattgggattatgcgggtttaatggaagtgtttaatggtaatggtggttatgattctggtgctggtaaaggtttaaaagccaaaactggtggtgaattagctgaagctattaaagttgccttagccaatactgatgggccaaccttaattgaatgttttattggtcgcgaagattgtaccgaagaattagttaaatggggtaaacgtgttgctgctgctaattctcgcaaacccgtgaataaattattgtaatttttggggatcaattcgagctcagcaagtttcatcccgaccccctcagggtcgggatttttttattgtactagttgacataagtaaaggcatcccctgcgtgatataattaccttcagtttaaggaggtatacacatatgagtgaaactaaatttaaagcctatgccgtaatgaatcctggtgaaaaattacaaccctgggaatatgaacctgctcctttacaggtagatgaaattgaagtaagagttactcacaatggtttatgtcacactgacttacacatgagagataatgactggaatgttagtgagttccccttagtagcaggtcatgaagttgttggtgaagtaaccgctgttggtgaaaaagtaaccagtcgtaaaaaaggtgatagagttggtgtaggttggattcgtaattcttgtcgcgcttgtgaccattgtttacaaggagaagagaacatttgtagagagggttatactggtttaattgttggtcatcacggtggatttgctgatcgtgtacgtgtacctgctgacttcacttataaaattcctgatgctttagatagtgcatctgctgctcctttattatgtgccggtattaccgtttacactcctttaagaacctacattaaacatcccggtatgaaagtaggtgttatgggtattggaggattaggacatttagctattaaatttgctcgtgcaatgggagcagaagttactgcctttagtaccagtcctaataaagaagcccaagccaaagaatttggtgctcatcatttccaacaatggggtactgctgaagaaatgaaagctgttgccggtaattttgatttagttttatctaccatctctgctgaaactgactgggatgctgccttctctttattagcaaataacggtgttttatgtttcgtaggtattcccgttagttctttaaatgttcctttaattcctttaattttcggacaaaaatctgttgtaggttctgtagttggaggaagaagattcatggcagaaatgttagagttcgccgctgtaaatcagattaaacctatgatcgaaactatgcccttatctcaagtaaatgaagctatggataaagttgccgccaataaagccagatatagaattgtattattatctgaataactagatctcctgcagagaatataaaaagccagattattaatccggcttttttattatttaaatactgtgcacgatcctgcaggatcatcttgctgaaaaactcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgccctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttgaatatttttcgtcagatacgcaaaccttacaaacataattaacaactgaaactattgatatgtctaggttttagctctatcacaggttggatctg

SEQ ID NO: 65 - DNA, 12648 bp, Cyanobacterium sp. ABICyano1
tcgacccaatatcttgtcatacatacttatttgcctcactattagccctatatgtctctattgtatttttctttttctcctattcctagatcttgtaatgaatcattactctctgaaatatagctactaattttatggttgtttgtaaaatatattaacaaatgaacaataaatcatattttgtgttaatctaattattagacaactactgaatttatattcagatattcacagataggagaattttgattatgaattcttataccgtgggtacttatttagccgaacgcttagtgcaaattggtttaaaacatcattttgccgtggctggggactataatttagtgttattggataacttattattaaataaaaacatggaacaagtgtattgttgtaatgaattaaattgtggtttttctgctgaaggttatgctagagctaaaggtgcagctgctgctgttgttacttattctgtgggtgctttatctgcttttgatgctattggtggtgcttatgccgaaaatttacccgtgattttaatttctggtgcccctaataataatgatcatgccgctggacatgttttacatcatgccttaggtaaaaccgattatcattatcaattagaaatggccaaaaatattactgctgctgccgaagctatttatactcctgaagaagcccctgccaaaattgatcatgtgattaaaaccgccttacgcgaaaaaaaacccgtgtatttagaaattgcctgtaatattgcttctatgccttgtgctgctcctgggcctgcttctgctttatttaatgatgaagcctctgatgaagctagtttaaatgctgccgtggaagaaaccttaaaatttattgccaatcgcgataaagttgccgtgttagttggttctaaattaagagctgctggtgctgaagaagctgctgttaaatttgctgatgctttaggtggtgcagttgctactatggctgctgccaaatctttttttcccgaagaaaatccccattatattggaactagttggggagaagtttcttatcctggtgtggaaaaaactatgaaagaagccgacgctgttattgctttagcccctgtgtttaatgattattctaccactggttggactgatattcccgatcccaaaaaattagttttagccgaacctcgttctgttgttgttaatggtgttcgctttccctctgtgcatttaaaagattatttaacccgcttagcccaaaaagtttctaaaaaaactggtgccttagatttttttaaatctttaaatgcgggtgaattaaaaaaagctgctcctgctgatccttctgctcctttagttaatgctgaaattgcccgtcaagttgaagccttattaacccctaatactaccgttattgccgaaactggtgattcttggtttaatgcccaacgcatgaaattacctaatggtgcccgtgttgaatatgaaatgcaatggggtcatattggttggtctgtacctgctgcttttggttatgctgttggtgctcctgaacgtcgtaatattttaatggtgggtgatggttcttttcaattaactgcccaagaagttgcccaaatggttcgcttaaaattacccgttattatttttttaataaataattatggttataccattgaagtgatgattcatgatgggccatataataatattaaaaattgggattatgcgggtttaatggaagtgtttaatggtaatggtggttatgattctggtgctggtaaaggtttaaaagccaaaactggtggtgaattagctgaagctattaaagttgccttagccaatactgatgggccaaccttaattgaatgttttattggtcgcgaagattgtaccgaagaattagttaaatggggtaaacgtgttgctgctgctaattctcgcaaacccgtgaataaattattgtaatttttggggatcaattcgagctcagcaagtttcatcccgaccccctcagggtcgggatttttttattgtactagttgacataagtaaaggcatcccctgcgtgatataattaccttcagtttaaggaggtatacacatatgagtgaaactaaatttaaagcctatgccgtaatgaatcctggtgaaaaattacaaccctgggaatatgaacctgctcctttacaggtagatgaaattgaagtaagagttactcacaatggtttatgtcacactgacttacacatgagagataatgactggaatgttagtgagttccccttagtagcaggtcatgaagttgttggtgaagtaaccgctgttggtgaaaaagtaaccagtcgtaaaaaaggtgatagagttggtgtaggttggattcgtaattcttgtcgcgcttgtgaccattgtttacaaggagaagagaacatttgtagagagggttatactggtttaattgttggtcatcacggtggatttgctgatcgtgtacgtgtacctgctgacttcacttataaaattcctgatgctttagatagtgcatctgctgctcctttattatgtgccggtattaccgtttacactcctttaagaacctacattaaacatcccggtatgaaagtaggtgttatgggtattggaggattaggacatttagctattaaatttgctcgtgcaatgggagcagaagttactgcctttagtaccagtcctaataaagaagcccaagccaaagaatttggtgctcatcatttccaacaatggggtactgctgaagaaatgaaagctgttgccggtaattttgatttagttttatctaccatctctgctgaaactgactgggatgctgccttctctttattagcaaataacggtgttttatgtttcgtaggtattcccgttagttctttaaatgttcctttaattcctttaattttcggacaaaaatctgttgtaggttctgtagttggaggaagaagattcatggcagaaatgttagagttcgccgctgtaaatcagattaaacctatgatcgaaactatgcccttatctcaagtaaatgaagctatggataaagttgccgccaataaagccagatatagaattgtattattatctgaataactagatctcctgcagagaatataaaaagccagattattaatccggcttttttattatttaaatactgtgcacgatcctgcaggatcatcttgctgaaaaactcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgccctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttgaatatttttcgtcagatacgcaaaccttacaaacataattaacaactgaaactattgatatgtctaggttttagctctatcacaggttggatctg

SEQ ID NO: 66 - DNA, 12711 bp, Cyanobacterium sp. ABICyano1
tcgacatacatggttggttcactgacttttaccccagttttctctttgaacaattggcataactctgaaaaaatcagatcgggcttttgttgaattatttgttcaatcaaagcaaaaccgtgattgtctattttcttttttttcccaccactcatagataaaaatttatcccgaactcaggttatattaagttcggatgatcacttaagataattgatcagattggttaagatagagaaaaattctttttcatagtgatttcataattgatagttacaataacgattattatttagtaaaaagattttcaaatcatgaattcttataccgtgggtacttatttagccgaacgcttagtgcaaattggtttaaaacatcattttgccgtggctggggactataatttagtgttattggataacttattattaaataaaaacatggaacaagtgtattgttgtaatgaattaaattgtggtttttctgctgaaggttatgctagagctaaaggtgcagctgctgctgttgttacttattctgtgggtgctttatctgcttttgatgctattggtggtgcttatgccgaaaatttacccgtgattttaatttctggtgcccctaataataatgatcatgccgctggacatgttttacatcatgccttaggtaaaaccgattatcattatcaattagaaatggccaaaaatattactgctgctgccgaagctatttatactcctgaagaagcccctgccaaaattgatcatgtgattaaaaccgccttacgcgaaaaaaaacccgtgtatttagaaattgcctgtaatattgcttctatgccttgtgctgctcctgggcctgcttctgctttatttaatgatgaagcctctgatgaagctagtttaaatgctgccgtggaagaaaccttaaaatttattgccaatcgcgataaagttgccgtgttagttggttctaaattaagagctgctggtgctgaagaagctgctgttaaatttgctgatgctttaggtggtgcagttgctactatggctgctgccaaatctttttttcccgaagaaaatccccattatattggaactagttggggagaagtttcttatcctggtgtggaaaaaactatgaaagaagccgacgctgttattgctttagcccctgtgtttaatgattattctaccactggttggactgatattcccgatcccaaaaaattagttttagccgaacctcgttctgttgttgttaatggtgttcgctttccctctgtgcatttaaaagattatttaacccgcttagcccaaaaagtttctaaaaaaactggtgccttagatttttttaaatctttaaatgcgggtgaattaaaaaaagctgctcctgctgatccttctgctcctttagttaatgctgaaattgcccgtcaagttgaagccttattaacccctaatactaccgttattgccgaaactggtgattcttggtttaatgcccaacgcatgaaattacctaatggtgcccgtgttgaatatgaaatgcaatggggtcatattggttggtctgtacctgctgcttttggttatgctgttggtgctcctgaacgtcgtaatattttaatggtgggtgatggttcttttcaattaactgcccaagaagttgcccaaatggttcgcttaaaattacccgttattatttttttaataaataattatggttataccattgaagtgatgattcatgatgggccatataataatattaaaaattgggattatgcgggtttaatggaagtgtttaatggtaatggtggttatgattctggtgctggtaaaggtttaaaagccaaaactggtggtgaattagctgaagctattaaagttgccttagccaatactgatgggccaaccttaattgaatgttttattggtcgcgaagattgtaccgaagaattagttaaatggggtaaacgtgttgctgctgctaattctcgcaaacccgtgaataaattattgtaatttttggggatcaattcgagctcagcaagtttcatcccgaccccctcagggtcgggatttttttattgtactagttgacataagtaaaggcatcccctgcgtgatataattaccttcagtttaaggaggtatacacatatgagtgaaactaaatttaaagcctatgccgtaatgaatcctggtgaaaaattacaaccctgggaatatgaacctgctcctttacaggtagatgaaattgaagtaagagttactcacaatggtttatgtcacactgacttacacatgagagataatgactggaatgttagtgagttccccttagtagcaggtcatgaagttgttggtgaagtaaccgctgttggtgaaaaagtaaccagtcgtaaaaaaggtgatagagttggtgtaggttggattcgtaattcttgtcgcgcttgtgaccattgtttacaaggagaagagaacatttgtagagagggttatactggtttaattgttggtcatcacggtggatttgctgatcgtgtacgtgtacctgctgacttcacttataaaattcctgatgctttagatagtgcatctgctgctcctttattatgtgccggtattaccgtttacactcctttaagaacctacattaaacatcccggtatgaaagtaggtgttatgggtattggaggattaggacatttagctattaaatttgctcgtgcaatgggagcagaagttactgcctttagtaccagtcctaataaagaagcccaagccaaagaatttggtgctcatcatttccaacaatggggtactgctgaagaaatgaaagctgttgccggtaattttgatttagttttatctaccatctctgctgaaactgactgggatgctgccttctctttattagcaaataacggtgttttatgtttcgtaggtattcccgttagttctttaaatgttcctttaattcctttaattttcggacaaaaatctgttgtaggttctgtagttggaggaagaagattcatggcagaaatgttagagttcgccgctgtaaatcagattaaacctatgatcgaaactatgcccttatctcaagtaaatgaagctatggataaagttgccgccaataaagccagatatagaattgtattattatctgaataactagatctcctgcagagaatataaaaagccagattattaatccggcttttttattatttaaatactgtgcacgatcctgcaggatcatcttgctgaaaaactcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgccctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttgaatatttttcgtcagatacgcaaaccttacaaacataattaacaactgaaactattgatatgtctaggttttagctctatcacaggttggatctg

SEQ ID NO: 67 - DNA, 13354 bp, Cyanobacterium sp. ABICyano1
aatatttttcgtcagatacgcaaaccttacaaacataattaacaactgaaactattgatatgtctaggttttagctctatcacaggttggatctgtcgacgatcctttttaacccatcacatatacctgccgttcactattatttagtgaaatgagatattatgatattttctgaattgtgattaaaaaggcaactttatgcccatgcaacagaaactataaaaaatacagagaatgaaaagaaacagatagattttttagttctttaggcccgtagtctgcaaatccttttatgattttctatcaaacaaaagaggaaaatagaccagttgcaatccaaacgagagtctaatagaatgaggtcgaaaagtaaatcgcgcgggtttgttactgataaagcaggcaagacctaaaatgtgtaaagggcaaagtgtatactttggcgtcaccccttacatattttaggtctttttttattgtgcgtaactaacttgccatcttcaaacaggagggctggaagaagcagaccgctaacacagtacataaaaaaggagacatgaacgatgaacatcaaaaagtttgcaaaacaagcaacagtattaacctttactaccgcactgctggcaggaggcgcaactcaagcgtttgcgaaagaaacgaaccaaaagccatataaggaaacatacggcatttcccatattacacgccatgatatgctgcaaatccctgaacagcaaaaaaatgaaaaatatcaagttcctgaattcgattcgtccacaattaaaaatatctcttctgcaaaaggcctggaggtttgggacagctggccattacaaaacgctgacggcactgtcgcaaactatcacggctaccacatcgtctttgcattagccggagatcctaaaaatgcggatgacacatcgatttacatgttctatcaaaaagtcggcgaaacttctattgacagctggaaaaacgctggccgcgtctttaaagacagcgacaaattcgatgcaaatgattctatcctaaaagaccaaacacaagaatggtcaggttcagccacatttacatctgacggaaaaatccgtttattctacactgatttctccggtaaacattacggcaaacaaacactgacaactgcacaagttaacgtatcagcatcagacagctctttgaacatcaacggtgtagaggattataaatcaatctttgacggtgacggaaaaacgtatcaaaatgtacagcagttcatcgatgaaggcaactacagctcaggcgacaaccatacgctgagagatcctcactacgtagaagataaaggccacaaatacttagtatttgaagcaaacactggaactgaagatggctaccaaggcgaagaatctttatttaacaaagcatactatggcaaaagcacatcattcttccgtcaagaaagtcaaaaacttctgcaaagcgataaaaaacgcacggctgagttagcaaacggcgctctcggtatgattgagctaaacgatgattacacactgaaaaaagtgatgaaaccgctgattgcatctaacacagtaacagatgaaattgaacgcgcgaacgtctttaaaatgaacggcaaatggtacctgttcactgactcccgcggatcaaaaatgacgattgacggcattacgtctaacgatatttacatgcttggttatgtttctaattctttaactggcccatacaagccgctgaacaaaactggccttgtgttaaaaatggatcttgatcctaacgatgtaacctttacttactcacacttcgctgtacctcaagcgaaaggaaacaatgtcgtgattacaagctatatgacaaacagaggattctacgcagacaaacaatcaacgtttgcgccaagcttcctgctgaacatcaaaggcaagaaaacatctgttgtcaaagacagcatccttgaacaaggacaattaacagttaacaaataaaaacgcaaaagaaaatgccgatatcctattggcattttcttttatttcttatcaacataaaggtgaatcccatatgaactatggatcggcgcagcatgctcccggccgccatcactagtgctcgatgacgctggttaatgccttaactgcttgttctacttcatcttcataaaaatctgcaactttcatcatcattgcatctaattcccccgtttcttcaccaatcatcatcatttgaattgccatagagggaaaaacctttctttccgagatcgcaacacttaacatacctccttctaaaatagaatcttttgcggcgccaatggcattagaaattactttattagggatagtctcttgagatatttctaaacattgtaagataggcacaccagaacgggttaaagtaccaaaaatacgacaaaaacgagcaacagcacttttttcatttaagtccccaaaaatgggagctttaagtgcgatcgtatctatttgtaaacgtccagcaggagttttataatattgacggaaggcaaaaacaaccccaataatcacacccacgggaataattgctttccagctacgcaaaaaatcactaagagtaaccataaattgagtcaaagccggcaattctgcacccaattggtcgaaaataccagcaaatacaggaatcaagaaaatggtcatacccaaaaaagcaatgaccgcaaaaataccaacagtgacaggataagccattgctgatttaatttggttttgcaaacgagcaacatcttcgagaagtttagcaagacgattcatgacttcgtctaaaaccccccctgtttctcccgcttctaccatactcacatatagcctatcaaaacagtcgggatgctttgccattgcttcagataaattaaccccctgttgaacatcctctccaatagtagttagagccttcttaaatttaggatttcctgattgctctgccaatactgacaaagagcggccgcatttaaatagcagcagattacgcgcagaaaaaaaggatctcaagaagatcctttgatcttttctacggggtctgacgctcagtggaacgaaaactcacgttaagggattttggtcatgaattaattcttaaaagaactcgtccaacattaaatgaaattgtaacttgttcatatcaggattatcaataccatatttctgaaataaacgtttctgtaaagaaggagaaaattcacctaaacaattccataaaatagctaaatcttgataacgatcagcaataccaacacgaccaacatcaatacaaccaatcaatttaccttcatcaaagatcaaattatctaaagaaaaatcaccatgagtaacaacagaatcaggagaaaaaggtaacaatttgtgcatttctttccaaacttgttcaacaggccaaccattacgttcatcatcaaaatcagaagcatcaactaaaccattattcatacgagattgagcttgagctaaacgaaaaacacgatcagaattaaaaggacaattacaaacgggaatagaatgtaaacgacgtaaaaaaacagctaaagcatcaacaatattttcaccagaatcaggatattcttctaaaacttgaaaagcagttttaccaggaatagcagtagttaataaccaagcatcatcgggagtacgaataaaatgtttaatagtaggtaaaggcataaattcagtcaaccagtttaaacgaaccatttcatcagtaacatcattagcaacagaacctttaccatgtttcaagaataattcaggagcatcaggtttaccatataaacgataaatagtagcaccagattgaccaacattatcacgagcccatttataaccatataaatcggcatccatattagaatttaaacgaggacgagaacaactagtttcacgttgaatatgagacatggttggtatcctccaaatatataaattttctttatagcgttatatgtaacaacttcttttaatggaagttagttttttggcttttgcttttcgagtttaaatcttatcatgaaggggatcattttctatacacccagattaactatttacgattattattttttctgaatttgattaacttaactaatctaattctctatgcttaccccagactattctctaggtattttaaactgctaatttttccctctttaacgttataaaagtcagaatttcacatttctttacactttgaggttaaattattacgattattagttttccttatgttttaattaaaaaggtaacgatgcactaggcaaaggagaattgttgataattaataacttctaactctttcctgtacgggagaatgcccattagcccctaactaactccgtaccgctttgcggaacgagcgctcgagcgttctctccgaactaatttctccctctcccctcatctataataagatagttaataattacatcgacaattgtctacgtaggcgcgccatgcggccttgacggccttccgccaattcgccctatagtgagtcgtattacgtcgcgctcactggccgtcgttttacaacgtcgtgactgggaaaaccctggcgttacccaacttaatcgccttgcagcacatccccctttcgccagctgcgccggatccctgcaggtcgacgatcgcaggtgtcacaatcatgatttcttgagccattgccctaccaaattcgcccggtttgggatttttctttttagccaaagtttgagcaaatactgccaataaagagttagataacattgctctaatttgggcttgttctgccgaaggaaatacatcaataatacgatcaattgttcccgccgcagagctagtatgtaaagtaccaaagacaaggtgtccagtttccgccgccgtaatcgccaaagaaatggtttctaagtcgcgcatctcacccactagaataatatctggatcttcccttaacgccgcttttaaggcattggcaaaacttttagtatcttctcctttttgacgttggtgaaatagactgttaatattgggaaaaacatactcgatcggatcttctactgttaagatgtgttctgcacgagtgcggttaattaagtccaacattgccgctaaagtagtagtttttccagaacctgtctgccctgtcactaaaatcatacccctagggcgttcggacatctccttgacaatatctggtaagcctaattgatcaaaattgggaattttggaagataaagcccttaaacaagcggcataacaacccctttccttataaacatttacacgaaatcgagccaagccttttaccccgtaggaacagtctaactcccattcttgctctaatgttttacgttgagtattattgagcatactaaaaattaatttttggcactcttgagcattaaggggttcatctccaatgcaaaattacgtacacgtgttattactttgttaacgacaattgtcttaattaactggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttg

SEQ ID NO: 68 - DNA, 6005 bp, Cyanobacterium sp. ABICyano1
ctagaatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctaatgcatattttaccctcgacaaatccaagaccatgcaacatttagggtagaattatttttatactcgtaatgtgattgatgtttataacccatgatttttcccgatttttctgcattttctaaccttgttcatcagggaaattttattcctgtttatcgagaattggtagcggatttagaaacccctgtttctgcttggtataaagtttgtgcagaccagccctatagtttcttgttagagtcagtagaaggtggggaaaatttaggaagatatagctttttaggttgtgatcctgtttggatactagaagcaaggggaaatcagaccaaacaagttcatcgtgatggtaaaatcgaaactttttcaggaaatccctttaacatcctctctcaatgtttagaaactattaaacctgttaaattaccagagttgccccccggtattggcggactatttggttattggggttatgagttaatttcttggattgaaccacgagtcaacgtttatcctgcctctgcggaaagtttacccgatggtatttggatgcaggtagataatttattgatttttgatcaagtaaaaagaaaaatatgggcgatcgcatatgcagatttaagacaggagcatttaagcctagaagaaatctacaatcaggcttgtgacaaaatttctaaattagttttaaaactacaattacctttaccagtatccgcaaaaccccttgaatttaaccccccgccaaaaactcaaaaaaatcatcgcattcaatacaaaagcaacaccagcaaagaggcattttgtgccaatgtggaaaaagctaaagaatacattaaagcaggagatatttttcaagtagtcatttctcagaaattacaatctcattatcaaggtcatccttttgagttgtatcgctccttacgtttgattaacccttccccttatatggcttactataactttcatggatggcagttaatcggctcttctcccgaagtaatggttaaagcagaaaaaactaatgatggtaaaaccaaagccgtagtccgtcccattgcaggaacacgtccaaggggcagaaactatcaagaagaccaatttttagcccaagacttactcaatgatcccaaagaaagggcagaacacgtcatgttagtagatttgggcagaaatgacttaggcagggtctgtgtaaaaggaagcgtggaagtcgatgaattgatggttattgaacgttattcccacgtaatgcacatagtcagtaacgttgtgggagagttagcaggggattactgtgcatgggatttactaaaggcggctttccccgcaggtacggtaagtggagctcctaaaattcgagcaatggaaattattaatgaacttgaacccgaaaggaggggaccttattctggggtttatggttactatgattttgaaggacagttaaatactgctatcacaattagaacgatggttgtggaaaccctttctgggacggaaaatcacttggtatccgttcaagctggagcaggcttagtcgctgactcagatccagacaaggagtatcaagaaactttgaataaagctagaggtttgctagaggcgattagtagcttaagctaagtgaaaattcgtaataaaaaagagcaaatttttgtgactttaaacctgacacctgaaatttatttttgaactccgaacccaaataatgattcaggttgcttaaactcagagaatcattaataattgattcttgttaactcaattgtcatttttaacatgggtgttgaactccgaagctatgtctatctcgatcgattacaacctcaacacgcttcctatataggtacggttgctctaggatttttacctttacccggtgatgcttctttatggattgaaatatcccccggaattgaaataaatcgaattactgatgtggctttgaagtctgctggtcgacttctgcagcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatggtaagatcaagtaacgacgtaacccagcaaggtagtagacctaaaacaaagttgggaggctcaagtatgggtatcattcgcacttgtaggttagggcccgatcaagtgaaatctatgcgagctgctttagatctttttggtagagaatttggtgatgttgcaacttatagtcaacatcaaccagattccgactatttgggaaatcttttacgttctaaaacattcattgcattagcagcatttgatcaggaagctgttgtcggtgcattagccgcttatgttttacccaagtttgaacaacctcgttctgagatctatatctacgatttagcggtatctggcgagcatcgtcgccaagggatagcaacagcgttaatcaatttgttaaagcatgaagctaatgctcttggtgcctatgtgatttacgttcaagcggactatggagatgatcctgccgtagccttgtataccaaacttggaattagagaagaagttatgcactttgatattgatccttctactgctacttaacaattcgttcaagccgagatttaaattacgtacacggcggccgcgaataggaaatctcagttcagagttcggggtgttcactgcactagtcatgaacgggatttttaattcttaattcttaattcttaattatcaattatttaacgtcagttcgggtttgagaatgaaaaaaccctagggataaaggggggtttgcccctagccctttttataaaaaaagaattaaaagctaatcagaaatgaaaaaaataggcagtttaggagagaaaataattgcccagtggttaataaataaaggttattctgttatagaatcaaattggcattgtcgttggggtgaaattgaccttatagtaataaataaaagtttaaaagagattatatttgttgaagttaaaactcgcagtataaaaaattgggatgataatgggctatactctattaataacaaaaaacaagaaaaactctggttaacagctagtttatttttagaaaaaaatcaaatatttactgattggaactgtcgttttgatattgctttattaacttacaaaaaattaactaactttgggacagtattttctgttaacgataattgtttaagaccaaagtttaactatgaaggctatcaatttgaaattgttgattatttggaaaatgctttttaatctgatcttctgcacgtcaaatagtattctacaagacaattcagaatttagaatatattttttggcgttgcttaattatggtatgaaatttactgaaattatgccaaaaattgagacatcaaaatattatcattactgcaagaatgcccatttccccaaccccacctaaatgagaaatcatatacaaaactagtaaagcctatttttttgttacgagattatcccctaactttccattgaggaatcttcaattgtttatcaatgctttttctgctataattgcactcatggtaaggattgaaaacctaaattttaaggtcaattatcttaacttaatcgatagttgtctaagtataactaattgttatagttcatgaagatcaaaatatattgcattttccgcagtattgacagaaacagaagttagtaataaagcaacactatgggtatcagagaaatagttgataattcaagcgatttagaatttagaatcgttagattgatgctaatgccaatagaaatagaattaacttttattaaagaaatagctactattcctttagtctcagctcaaaattagtggactctctactaaattctgtttaggattgccttgttagttaataaattcgctattctcctgattatttttgcgaggagaaaagtcaagtatttacttttttaaaattatgtataaagatataattagtcaccgattaaaactttcattttaagatgatatgagtctaattgtgaacatggaaaagtcgggttttttaaattttacaacttttaggaaactgaaaatataaagtatgaaaaactttatttattcctgaagtcaataggacaaagttcgatgggcaaagggcaaaatgattttgcaagtaccttgacaaaccaaaaattactcgtcttaaaagactgagttttaaacccattgttctttgataaatgataaagaaacgataggataagttaataaaaaatgattttctgggaatcacaagaatttatgaagagatataaaaaaactttcctaagttaagaaaattaagaaaaactaatccatgagactacataaaaacaaggcaaaattttaagattgaactaacattaataattgatttctttaccataattactttgtcttttcataactaattgtgattaaaacagttgaaagtcagactctttttattagctttatatcgttaactaaacattatctgattgtgacaaatttaagcaaaatattttcaaaattatcaacacagaagcgaaaattttgtgaggatatcaat

SEQ ID NO: 69 - DNA, 9189 bp, Cyanobacterium sp. ABICyano1
gcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatggtaagatcaagtaacgacgtaacccagcaaggtagtagacctaaaacaaagttgggaggctcaagtatgggtatcattcgcacttgtaggttagggcccgatcaagtgaaatctatgcgagctgctttagatctttttggtagagaatttggtgatgttgcaacttatagtcaacatcaaccagattccgactatttgggaaatcttttacgttctaaaacattcattgcattagcagcatttgatcaggaagctgttgtcggtgcattagccgcttatgttttacccaagtttgaacaacctcgttctgagatctatatctacgatttagcggtatctggcgagcatcgtcgccaagggatagcaacagcgttaatcaatttgttaaagcatgaagctaatgctcttggtgcctatgtgatttacgttcaagcggactatggagatgatcctgccgtagccttgtataccaaacttggaattagagaagaagttatgcactttgatattgatccttctactgctacttaacaattcgttcaagccgagatttaaattacgtacacggcggccgcgaataggaaatctcagttcagagttcggggtgttcactgcactagtcatgaacgggatttttaattcttaattcttaattcttaattatcaattatttaacgtcagttcgggtttgagaatgaaaaaaccctagggataaaggggggtttgcccctagccctttttataaaaaaagaattaaaagctaatcagaaatgaaaaaaataggcagtttaggagagaaaataattgcccagtggttaataaataaaggttattctgttatagaatcaaattggcattgtcgttggggtgaaattgaccttatagtaataaataaaagtttaaaagagattatatttgttgaagttaaaactcgcagtataaaaaattgggatgataatgggctatactctattaataacaaaaaacaagaaaaactctggttaacagctagtttatttttagaaaaaaatcaaatatttactgattggaactgtcgttttgatattgctttattaacttacaaaaaattaactaactttgggacagtattttctgttaacgataattgtttaagaccaaagtttaactatgaaggctatcaatttgaaattgttgattatttggaaaatgctttttaatctgatcttctgcacgtcaaatagtattctacaagacaattcagaatttagaatatattttttggcgttgcttaattatggtatgaaatttactgaaattatgccaaaaattgagacatcaaaatattatcattactgcaagaatgcccatttccccaaccccacctaaatgagaaatcatatacaaaactagtaaagcctatttttttgttacgagattatcccctaactttccattgaggaatcttcaattgtttatcaatgctttttctgctataattgcactcatggtaaggattgaaaacctaaattttaaggtcaattatcttaacttaatcgatagttgtctaagtataactaattgttatagttcatgaagatcaaaatatattgcattttccgcagtattgacagaaacagaagttagtaataaagcaacactatgggtatcagagaaatagttgataattcaagcgatttagaatttagaatcgttagattgatgctaatgccaatagaaatagaattaacttttattaaagaaatagctactattcctttagtctcagctcaaaattagtggactctctactaaattctgtttaggattgccttgttagttaataaattcgctattctcctgattatttttgcgaggagaaaagtcaagtatttacttttttaaaattatgtataaagatataattagtcaccgattaaaactttcattttaagatgatatgagtctaattgtgaacatggaaaagtcgggttttttaaattttacaacttttaggaaactgaaaatataaagtatgaaaaactttatttattcctgaagtcaataggacaaagttcgatgggcaaagggcaaaatgattttgcaagtaccttgacaaaccaaaaattactcgtcttaaaagactgagttttaaacccattgttctttgataaatgataaagaaacgataggataagttaataaaaaatgattttctgggaatcacaagaatttatgaagagatataaaaaaactttcctaagttaagaaaattaagaaaaactaatccatgagactacataaaaacaaggcaaaattttaagattgaactaacattaataattgatttctttaccataattactttgtcttttcataactaattgtgattaaaacagttgaaagtcagactctttttattagctttatatcgttaactaaacattatctgattgtgacaaatttaagcaaaatattttcaaaattatcaacacagaagcgaaaattttgtgaggatatcaatctagaatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctaatgcatattttaccctcgacaaatccaagaccatgcaacatttagggtagaattatttttatactcgtaatgtgattgatgtttataacccatgatttttcccgatttttctgcattttctaaccttgttcatcagggaaattttattcctgtttatcgagaattggtagcggatttagaaacccctgtttctgcttggtataaagtttgtgcagaccagccctatagtttcttgttagagtcagtagaaggtggggaaaatttaggaagatatagctttttaggttgtgatcctgtttggatactagaagcaaggggaaatcagaccaaacaagttcatcgtgatggtaaaatcgaaactttttcaggaaatccctttaacatcctctctcaatgtttagaaactattaaacctgttaaattaccagagttgccccccggtattggcggactatttggttattggggttatgagttaatttcttggattgaaccacgagtcaacgtttatcctgcctctgcggaaagtttacccgatggtatttggatgcaggtagataatttattgatttttgatcaagtaaaaagaaaaatatgggcgatcgcatatgcagatttaagacaggagcatttaagcctagaagaaatctacaatcaggcttgtgacaaaatttctaaattagttttaaaactacaattacctttaccagtatccgcaaaaccccttgaatttaaccccccgccaaaaactcaaaaaaatcatcgcattcaatacaaaagcaacaccagcaaagaggcattttgtgccaatgtggaaaaagctaaagaatacattaaagcaggagatatttttcaagtagtcatttctcagaaattacaatctcattatcaaggtcatccttttgagttgtatcgctccttacgtttgattaacccttccccttatatggcttactataactttcatggatggcagttaatcggctcttctcccgaagtaatggttaaagcagaaaaaactaatgatggtaaaaccaaagccgtagtccgtcccattgcaggaacacgtccaaggggcagaaactatcaagaagaccaatttttagcccaagacttactcaatgatcccaaagaaagggcagaacacgtcatgttagtagatttgggcagaaatgacttaggcagggtctgtgtaaaaggaagcgtggaagtcgatgaattgatggttattgaacgttattcccacgtaatgcacatagtcagtaacgttgtgggagagttagcaggggattactgtgcatgggatttactaaaggcggctttccccgcaggtacggtaagtggagctcctaaaattcgagcaatggaaattattaatgaacttgaacccgaaaggaggggaccttattctggggtttatggttactatgattttgaaggacagttaaatactgctatcacaattagaacgatggttgtggaaaccctttctgggacggaaaatcacttggtatccgttcaagctggagcaggcttagtcgctgactcagatccagacaaggagtatcaagaaactttgaataaagctagaggtttgctagaggcgattagtagcttaagctaagtgaaaattcgtaataaaaaagagcaaatttttgtgactttaaacctgacacctgaaatttatttttgaactccgaacccaaataatgattcaggttgcttaaactcagagaatcattaataattgattcttgttaactcaattgtcatttttaacatgggtgttgaactccgaagctatgtctatctcgatcgattacaacctcaacacgcttcctatataggtacggttgctctaggatttttacctttacccggtgatgcttctttatggattgaaatatcccccggaattgaaataaatcgaattactgatgtggctttgaagtctgctggtcgacatacatggttggttcactgacttttaccccagttttctctttgaacaattggcataactctgaaaaaatcagatcgggcttttgttgaattatttgttcaatcaaagcaaaaccgtgattgtctattttcttttttttcccaccactcatagataaaaatttatcccgaactcaggttatattaagttcggatgatcacttaagataattgatcagattggttaagatagagaaaaattctttttcatagtgatttcataattgatagttacaataacgattattatttagtaaaaagattttcaaatcatgaattcttataccgtgggtacttatttagccgaacgcttagtgcaaattggtttaaaacatcattttgccgtggctggggactataatttagtgttattggataacttattattaaataaaaacatggaacaagtgtattgttgtaatgaattaaattgtggtttttctgctgaaggttatgctagagctaaaggtgcagctgctgctgttgttacttattctgtgggtgctttatctgcttttgatgctattggtggtgcttatgccgaaaatttacccgtgattttaatttctggtgcccctaataataatgatcatgccgctggacatgttttacatcatgccttaggtaaaaccgattatcattatcaattagaaatggccaaaaatattactgctgctgccgaagctatttatactcctgaagaagcccctgccaaaattgatcatgtgattaaaaccgccttacgcgaaaaaaaacccgtgtatttagaaattgcctgtaatattgcttctatgccttgtgctgctcctgggcctgcttctgctttatttaatgatgaagcctctgatgaagctagtttaaatgctgccgtggaagaaaccttaaaatttattgccaatcgcgataaagttgccgtgttagttggttctaaattaagagctgctggtgctgaagaagctgctgttaaatttgctgatgctttaggtggtgcagttgctactatggctgctgccaaatctttttttcccgaagaaaatccccattatattggaactagttggggagaagtttcttatcctggtgtggaaaaaactatgaaagaagccgacgctgttattgctttagcccctgtgtttaatgattattctaccactggttggactgatattcccgatcccaaaaaattagttttagccgaacctcgttctgttgttgttaatggtgttcgctttccctctgtgcatttaaaagattatttaacccgcttagcccaaaaagtttctaaaaaaactggtgccttagatttttttaaatctttaaatgcgggtgaattaaaaaaagctgctcctgctgatccttctgctcctttagttaatgctgaaattgcccgtcaagttgaagccttattaacccctaatactaccgttattgccgaaactggtgattcttggtttaatgcccaacgcatgaaattacctaatggtgcccgtgttgaatatgaaatgcaatggggtcatattggttggtctgtacctgctgcttttggttatgctgttggtgctcctgaacgtcgtaatattttaatggtgggtgatggttcttttcaattaactgcccaagaagttgcccaaatggttcgcttaaaattacccgttattatttttttaataaataattatggttataccattgaagtgatgattcatgatgggccatataataatattaaaaattgggattatgcgggtttaatggaagtgtttaatggtaatggtggttatgattctggtgctggtaaaggtttaaaagccaaaactggtggtgaattagctgaagctattaaagttgccttagccaatactgatgggccaaccttaattgaatgttttattggtcgcgaagattgtaccgaagaattagttaaatggggtaaacgtgttgctgctgctaattctcgcaaacccgtgaataaattattgtaatttttggggatcaattcgagctcagcaagtttcatcccgaccccctcagggtcgggatttttttattgtactagttgacataagtaaaggcatcccctgcgtgatataattaccttcagtttaaggaggtatacacatatgagtgaaactaaatttaaagcctatgccgtaatgaatcctggtgaaaaattacaaccctgggaatatgaacctgctcctttacaggtagatgaaattgaagtaagagttactcacaatggtttatgtcacactgacttacacatgagagataatgactggaatgttagtgagttccccttagtagcaggtcatgaagttgttggtgaagtaaccgctgttggtgaaaaagtaaccagtcgtaaaaaaggtgatagagttggtgtaggttggattcgtaattcttgtcgcgcttgtgaccattgtttacaaggagaagagaacatttgtagagagggttatactggtttaattgttggtcatcacggtggatttgctgatcgtgtacgtgtacctgctgacttcacttataaaattcctgatgctttagatagtgcatctgctgctcctttattatgtgccggtattaccgtttacactcctttaagaacctacattaaacatcccggtatgaaagtaggtgttatgggtattggaggattaggacatttagctattaaatttgctcgtgcaatgggagcagaagttactgcctttagtaccagtcctaataaagaagcccaagccaaagaatttggtgctcatcatttccaacaatggggtactgctgaagaaatgaaagctgttgccggtaattttgatttagttttatctaccatctctgctgaaactgactgggatgctgccttctctttattagcaaataacggtgttttatgtttcgtaggtattcccgttagttctttaaatgttcctttaattcctttaattttcggacaaaaatctgttgtaggttctgtagttggaggaagaagattcatggcagaaatgttagagttcgccgctgtaaatcagattaaacctatgatcgaaactatgcccttatctcaagtaaatgaagctatggataaagttgccgccaataaagccagatatagaattgtattattatctgaataactagatctcctgca

SEQ ID NO: 70 - DNA, 5870 bp, Cyanobacterium sp. ABICyano1
catggtaagatcaagtaacgacgtaacccagcaaggtagtagacctaaaacaaagttgggaggctcaagtatgggtatcattcgcacttgtaggttagggcccgatcaagtgaaatctatgcgagctgctttagatctttttggtagagaatttggtgatgttgcaacttatagtcaacatcaaccagattccgactatttgggaaatcttttacgttctaaaacattcattgcattagcagcatttgatcaggaagctgttgtcggtgcattagccgcttatgttttacccaagtttgaacaacctcgttctgagatctatatctacgatttagcggtatctggcgagcatcgtcgccaagggatagcaacagcgttaatcaatttgttaaagcatgaagctaatgctcttggtgcctatgtgatttacgttcaagcggactatggagatgatcctgccgtagccttgtataccaaacttggaattagagaagaagttatgcactttgatattgatccttctactgctacttaacaattcgttcaagccgagatttaaattacgtacacggcggccgcgaataggaaatctcagttcagagttcggggtgttcactgcactagtcatgaacgggatttttaattcttaattcttaattcttaattatcaattatttaacgtcagttcgggtttgagaatgaaaaaaccctagggataaaggggggtttgcccctagccctttttataaaaaaagaattaaaagctaatcagaaatgaaaaaaataggcagtttaggagagaaaataattgcccagtggttaataaataaaggttattctgttatagaatcaaattggcattgtcgttggggtgaaattgaccttatagtaataaataaaagtttaaaagagattatatttgttgaagttaaaactcgcagtataaaaaattgggatgataatgggctatactctattaataacaaaaaacaagaaaaactctggttaacagctagtttatttttagaaaaaaatcaaatatttactgattggaactgtcgttttgatattgctttattaacttacaaaaaattaactaactttgggacagtattttctgttaacgataattgtttaagaccaaagtttaactatgaaggctatcaatttgaaattgttgattatttggaaaatgctttttaatctgatcttctgcacgtcaaatagtattctacaagacaattcagaatttagaatatattttttggcgttgcttaattatggtatgaaatttactgaaattatgccaaaaattgagacatcaaaatattatcattactgcaagaatgcccatttccccaaccccacctaaatgagaaatcatatacaaaactagtaaagcctatttttttgttacgagattatcccctaactttccattgaggaatcttcaattgtttatcaatgctttttctgctataattgcactcatggtaaggattgaaaacctaaattttaaggtcaattatcttaacttaatcgatagttgtctaagtataactaattgttatagttcatgaagatcaaaatatattgcattttccgcagtattgacagaaacagaagttagtaataaagcaacactatgggtatcagagaaatagttgataattcaagcgatttagaatttagaatcgttagattgatgctaatgccaatagaaatagaattaacttttattaaagaaatagctactattcctttagtctcagctcaaaattagtggactctctactaaattctgtttaggattgccttgttagttaataaattcgctattctcctgattatttttgcgaggagaaaagtcaagtatttacttttttaaaattatgtataaagatataattagtcaccgattaaaactttcattttaagatgatatgagtctaattgtgaacatggaaaagtcgggttttttaaattttacaacttttaggaaactgaaaatataaagtatgaaaaactttatttattcctgaagtcaataggacaaagttcgatgggcaaagggcaaaatgattttgcaagtaccttgacaaaccaaaaattactcgtcttaaaagactgagttttaaacccattgttctttgataaatgataaagaaacgataggataagttaataaaaaatgattttctgggaatcacaagaatttatgaagagatataaaaaaactttcctaagttaagaaaattaagaaaaactaatccatgagactacataaaaacaaggcaaaattttaagattgaactaacattaataattgatttctttaccataattactttgtcttttcataactaattgtgattaaaacagttgaaagtcagactctttttattagctttatatcgttaactaaacattatctgattgtgacaaatttaagcaaaatattttcaaaattatcaacacagaagcgaaaattttgtgaggatatcaatctagaatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctaatgcatattttaccctcgacaaatccaagaccatgcaacatttagggtagaattatttttatactcgtaatgtgattgatgtttataacccatgatttttcccgatttttctgcattttctaaccttgttcatcagggaaattttattcctgtttatcgagaattggtagcggatttagaaacccctgtttctgcttggtataaagtttgtgcagaccagccctatagtttcttgttagagtcagtagaaggtggggaaaatttaggaagatatagctttttaggttgtgatcctgtttggatactagaagcaaggggaaatcagaccaaacaagttcatcgtgatggtaaaatcgaaactttttcaggaaatccctttaacatcctctctcaatgtttagaaactattaaacctgttaaattaccagagttgccccccggtattggcggactatttggttattggggttatgagttaatttcttggattgaaccacgagtcaacgtttatcctgcctctgcggaaagtttacccgatggtatttggatgcaggtagataatttattgatttttgatcaagtaaaaagaaaaatatgggcgatcgcatatgcagatttaagacaggagcatttaagcctagaagaaatctacaatcaggcttgtgacaaaatttctaaattagttttaaaactacaattacctttaccagtatccgcaaaaccccttgaatttaaccccccgccaaaaactcaaaaaaatcatcgcattcaatacaaaagcaacaccagcaaagaggcattttgtgccaatgtggaaaaagctaaagaatacattaaagcaggagatatttttcaagtagtcatttctcagaaattacaatctcattatcaaggtcatccttttgagttgtatcgctccttacgtttgattaacccttccccttatatggcttactataactttcatggatggcagttaatcggctcttctcccgaagtaatggttaaagcagaaaaaactaatgatggtaaaaccaaagccgtagtccgtcccattgcaggaacacgtccaaggggcagaaactatcaagaagaccaatttttagcccaagacttactcaatgatcccaaagaaagggcagaacacgtcatgttagtagatttgggcagaaatgacttaggcagggtctgtgtaaaaggaagcgtggaagtcgatgaattgatggttattgaacgttattcccacgtaatgcacatagtcagtaacgttgtgggagagttagcaggggattactgtgcatgggatttactaaaggcggctttccccgcaggtacggtaagtggagctcctaaaattcgagcaatggaaattattaatgaacttgaacccgaaaggaggggaccttattctggggtttatggttactatgattttgaaggacagttaaatactgctatcacaattagaacgatggttgtggaaaccctttctgggacggaaaatcacttggtatccgttcaagctggagcaggcttagtcgctgactcagatccagacaaggagtatcaagaaactttgaataaagctagaggtttgctagaggcgattagtagcttaagctaagtgaaaattcgtaataaaaaagagcaaatttttgtgactttaaacctgacacctgaaatttatttttgaactccgaacccaaataatgattcaggttgcttaaactcagagaatcattaataattgattcttgttaactcaattgtcatttttaacatgggtgttgaactccgaagctatgtctatctcgatcgattacaacctcaacacgcttcctatataggtacggttgctctaggatttttacctttacccggtgatgcttctttatggattgaaatatcccccggaattgaaataaatcgaattactgatgtggctttgaagtctgctggtcgacttctgcagtgagaaaaagtgtaaacaaatattaagaaaaagatcagaaaaatttaacaacacgtaataaaaaaatgcgtcactacgggttataaatttacatgaaaggttaaaacacttttctgagacgattttgataaaaaagttgtcaaaaaattaagtttctttacaaatgcttaacaaaaacttggttttaagcacaaaataagagagactaatttgcagaagttttacaaggaaatcttgaagaaaaagatctaagtaaaacgactctgtttaaccaaaatttaacaaatttaacaaaacaaactaaatctattaggagattaactaaaac

SEQ ID NO: 71 - DNA, 6097 bp, Cyanobacterium sp. ABICyano1
ggccgctaatggtagtctgtgtcttgcaacctgttcggatcaggtaagggcatttataaagcagaactaaataaaatctctgctacctgtacggcagtatataaaggaaattaatatgacttacgcagtaattgaaatctgtggaaaacaacttaaagttgaaccaggcagattttacgatatagacagaatcaatcaagaatcagaaatcgaagtatccatcgataaggtacttttagttagtcatgacaatgatattcatgtaggacaaccttacgtggaaggtgcgacagtaagcggtacaatcattgatcatcgtcggggcaaaaaagttttggtctacaaaatgaagcccaaaaagaaaactcgcaaaaaaagaggtcatagacaagaattaacacgcttaatgatcgattctattagtattgatggcaatgtaattgcagaaaaaacctctgaatctaaatctgtagaaacagaagttgcgatcgaggcttaacataaagcacaataaaaataatatttaatttgatttaaccttaaatttttgctcaggagtatataaaatggcacataagaaaggtactggtagtactagaaacggaagagattctaattctaagcgtctaggtgtaaaacgttatagcggagaaacagtaaccgcaggaagtatcttagttcgtcaacgtggtactaaagtttatcccggtaataatgttggtattggtaaagatgatactctttttgctttaattgaaggagttgttaaatttgaaaataaaactaccagtcgtaaaaaagtaagcgtatatcctgcttaaatttatgactaggtcaaaattaattaaagcttagttttaactattaattaacaaggggcttaagccccttatttttttgtctgctcgactgattacttatttaatttcaagttaattgttagctaggaagatgtgataaaaaagacgattgctattattccatgtcctgtaaaatattgtggaatatgtaatcaaaatgaaactaaaatatatgctagaactaatttctatttttagtgccgccgcattggggggagtattagcatccatacttcgacaaccggtcattctaggctatttattggcaggaattaccattggaccttttggattaggtttaattcaagaatatgaacaagtggaagtggtagcagaattgggtgttactttccttttatttgctttaggggtggaattttcctttgaggagttgaagaaagttaaagttattagtctaggaggaggaggtttacaaatcagcttgactattttaactacggtaattctctccacaagtttgggatgggtaaattctattcccgaaggggtattgttaggacaaatgctttctctttcctctacggcagtagtaattaaggtattgatggataataatgaaaaggataccccccaaggtcaggtaatgctgggaattcttataattcaggatttagctttaggtttaatgttagcagttttacctgcgttgaataaaccggcggaggaaattggtattgctatgattatcgctttagtcaaattaattctctttgctttaggggcgattatcgtgggtaaatggttagttcctcctattttaagattattagcaaaaactgagagtaaagaacttttcttgttaggagttgttactatttgcctaggtgttgctttatttactggtaaattgggactttccaccgaaatgggtgcatttgttgcaggtttaatgatttcagagattgaatatgctgatgaaaccctctcagatgttgaaccgttacgggatatttgttctattgcttttttcgcctctatcggagtgctaattaatcctatctttctttgggataacttaccaattattttggggttagtagctttagtcgtattaggaaaagccttattaattacccccattgtccttcttttccgttatcctttaaaaacggctcttgtttctggtttaggattagcacaaatcggatatcaatctagaatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctaatgcatattattgattaacttaggctgaagggcaacaggggattttaaatagtaaaagataaaattttaatcaattacttttgtgataataatttgaagctcttactttttattaaattatcataactactgtaaaagatctgaaaaatcctgcttatgaagctaagaataacttatgaatttacacttcttactaactcttaaaaaagactattaatcttattttatcactgccatattctggacttaaaattgccatctaaaccccttttgtctcttaaaaattgccaaataagagtaaagtattctttagcggcactgacggaatcacccatataacgacacaataacccctgttgtaaagctgttattcctattcctatattttcgtcatatttttcttttatcaaatggcgtaaattggaaatatattgattaatatcttctgaccctatataaactaaattacccaccactggatttccccctaaaccattggaagcgtaaaataaaggactatttcccataaaatattgcctatcaatccaaatcggtttgttttctcgccaaatctctaaataatttaaccaattaccttcactaaaaatttccccccttgcacttctaccgaaacgaattatttcccatcctaaccaactagcattatcttctaaatcaactctcattttttgctcaaaattagcattgttaaaaacaatcatttcttgtggtaaatattctaaataagcatttttttctagcttaatttttacttcttgaatagctttttttcccttagaaccatatatttttgttgccgcaggggtcgttattaaaacctgagaactatttgctaaacaaatattttgcgagagaatatcatctccagctattcctccagcagtatgtaaaataacgctgtgacaaacggatttcccttcaggataaaaagaattttgaaacttaaaaggtgcttgactaaatactgattttattgtcgtttcttgtttttgatgttcatataccagatttattattccttgccagtttttcattaattaatatctatttactaaaaattattaagaattttttatactaacaaaaataccatttattctattctaattattgtatttttcttgctctcttagcttagttgatagcaattatcccttaaaaaattgtttggagttcggggtaatatttttaattatcaactattcacttttgccccttaccctcttaccttttcccataagacaatttacacaactcaaatagaattgttatgtcctccattgtgaaaaaggattattggctagataagagttatagtaacgcaaatcgtcagttacttcctctcctatccattcagggagaataatatcttgattttcctctgtcaattctacttctgccattgtcaaacctttgttttcccctaaaaattcatctacttcccaagttaaattacctacaagtattttatagcgtattttttcaataaaggggcgatcgcacaaagtttgtaacatttcctcagcttcttccacaggaatagaatattcaaattctgatctcgtctgaccttttgttttacccttaagagtgagataaccctgcgcaccaacaatccgaaccctcacagtattaccactgatagtataaatatatccctgccgataaaccaaaccattgtcagggggaaaccacttatccaagttaactaaaaattttctctcaatttcgatacccattttcttgccaagaaaaataaattaatgttatactaacaaagtatcaaaaattagggcggcgtagccaagtggtaaggcagaggtctgcaaaacctttatcccccagttcgaatctgggcgtcgcctcttaagtaagactattttattatagactcttaggttctcacctctaaaccttgaactccaaatgtcgacttctgcagcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatggtaagatcaagtaacgacgtaacccagcaaggtagtagacctaaaacaaagttgggaggctcaagtatgggtatcattcgcacttgtaggttagggcccgatcaagtgaaatctatgcgagctgctttagatctttttggtagagaatttggtgatgttgcaacttatagtcaacatcaaccagattccgactatttgggaaatcttttacgttctaaaacattcattgcattagcagcatttgatcaggaagctgttgtcggtgcattagccgcttatgttttacccaagtttgaacaacctcgttctgagatctatatctacgatttagcggtatctggcgagcatcgtcgccaagggatagcaacagcgttaatcaatttgttaaagcatgaagctaatgctcttggtgcctatgtgatttacgttcaagcggactatggagatgatcctgccgtagccttgtataccaaacttggaattagagaagaagttatgcactttgatattgatccttctactgctacttaacaattcgttcaagccgagatttaaattacgtacacggc

SEQ ID NO: 72 - DNA, 12649 bp, Cyanobacterium sp. ABICyano1
tcgacaattaataacttcttcctgtacgggcgaatggccatttgctcctaactaactccgtactgctttgcggaacgagcgtagcgaactctccgaattactaagccttcatccctgatagatgcaaaaaacgaattaaaattatgtgtaaaaagaaaatgtgtctttatttagtagtcaaagttacaaaatattaagaatcaaattaataatgtattgggcagttaagtatataagtctttaaatatttatttgtattcaatatattaaggaggatcagccttatgaattcttacactgttggaacctatttagcagaacgtttagttcaaattggtctcaaacaccattttgcagtagctggtgattataatttagttttattggataacttattgttaaataagaatatggaacaagtgtattgttgtaatgaattaaactgtggtttttctgctgagggatatgctcgtgcaaaaggtgctgccgcagcagttgttacttattctgttggagcattaagtgcttttgacgctattggaggtgcttatgcagaaaatttacctgtaatcttaatctctggtgcacccaataacaacgatcacgctgctggtcatgtattgcatcatgctttaggtaaaaccgattatcattaccaattagaaatggcaaaaaatattaccgctgccgcagaagctatttatactcccgaagaagcacctgctaagatcgatcacgtaattaaaaccgctctccgtgagaaaaaacccgtatatttagaaatcgcttgcaatatcgcttctatgccttgtgcagctcctggacctgctagtgctttatttaacgatgaagcatctgatgaggctagtttaaatgccgctgttgaagaaactttgaaatttattgctaatcgtgataaagtagctgttttagttggttctaaactccgtgccgctggtgcagaagaagcggctgtaaaattcgcagatgccttaggaggtgctgttgccacaatggcagccgctaaaagttttttccccgaagaaaatcctcattacattggtacttcttggggtgaggtatcttaccctggtgtagaaaaaaccatgaaggaagctgatgcagtaattgcattagctcctgttttcaatgattactctaccactggttggactgatattccagaccccaaaaaattagttttagcagaacctcgctctgtagttgtgaatggtgttagatttcccagtgtacatctcaaagattatttaactcgtttagctcaaaaagtgagtaaaaagactggcgcactcgatttctttaaatctttaaatgctggtgaattaaagaaagcagctcctgctgatcccagtgctcctttagtgaatgccgaaatcgcaagacaagttgaagccttgttaactcctaacactaccgttattgccgagactggtgatagttggttcaatgctcaacgcatgaaattacccaatggtgctcgtgttgagtatgaaatgcaatggggtcacattggatggtctgttcctgctgcatttggatatgcagttggagcacctgagcgtagaaacattttaatggtaggtgatggttctttccaactcactgctcaagaagttgcacaaatggtacgtttaaaattgcctgttattatctttctcattaacaactatggttacaccattgaagttatgattcatgatggtccttataataacattaagaattgggattacgcaggtttaatggaggtatttaacggtaatggtggatacgacagtggagcaggtaaaggattaaaagctaaaacaggaggtgagttagctgaagcaattaaagtagctttagccaatacagatggtcctaccttaatcgaatgtttcattggacgtgaagattgtactgaagagttagttaaatggggaaagcgtgttgccgctgcaaattctcgtaaacctgtaaacaaactcttgtagttaggatccgagctcagcaagtttcatcccgaccccctcagggtcgggatttttttattgtactagttgacataagtaaaggcatcccctgcgtgatataattaccttcagtttaaggaggtatacacatatgattaaagcctacgctgccctggaagccaacggaaaactccaaccctttgaatacgaccccggtgccctgggtgctaatgaggtggagattgaggtgcagtattgtggggtgtgccacagtgatttgtccatgattaataacgaatggggcatttccaattaccccctagtgccgggtcatgaggtggtgggtactgtggccgccatgggcgaaggggtgaaccatgttgaggtgggggatttagtggggctgggttggcattcgggctactgcatgacctgccatagttgtttatctggctaccacaacctttgtgccacggcggaatcgaccattgtgggccactacggtggctttggcgatcgggttcgggccaagggagtcagcgtggtgaaattacctaaaggcattgacctagccagtgccgggccccttttctgtggaggaattaccgttttcagtcctatggtggaactgagtttaaagcccactgcaaaagtggcagtgatcggcattgggggcttgggccatttagcggtgcaatttctccgggcctggggctgtgaagtgactgcctttacctccagtgccaggaagcaaacggaagtgttggaattgggcgctcaccacatactagattccaccaatccagaggcgatcgccagtgcggaaggcaaatttgactatattatctccactgtgaacctgaagcttgactggaacttatacatcagcaccctggcgccccagggacatttccactttgttggggtggtgttggagcctttggatctaaatctttttccccttttgatgggacaacgctccgtttctgcctccccagtgggtagtcccgccaccattgccaccatgttggactttgctgtgcgccatgacattaaacccgtggtggaacaatttagctttgatcagatcaacgaggcgatcgcccatctagaaagcggcaaagcccattatcgggtagtgctcagccatagtaaaaattagctctgcaaaggttgcttctgggtccgtggaacgctcggttgccgccgggcgttttttattcctgcaggatcatcttgctgaaaaactcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgccctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttgaatatttttcgtcagatacgcaaaccttacaaacataattaacaactgaaactattgatatgtctaggttttagctctatcacaggttggatctg

SEQ ID NO: 73 - DNA, 12552 bp, Cyanobacterium sp. ABICyano1
tcgactaagccttcatccctgatagatgcaaaaaacgcattaaaattatgcgtaaaaagcatatttgtctttatttagtaatcaaagttacaaattattaagaatcaaattaataatatattgggcagttaagtatataagtctttaaatatttatttgtattcaatatattaaggaggtgatcattatgaattcttacactgttggaacctatttagcagaacgtttagttcaaattggtctcaaacaccattttgcagtagctggtgattataatttagttttattggataacttattgttaaataagaatatggaacaagtgtattgttgtaatgaattaaactgtggtttttctgctgagggatatgctcgtgcaaaaggtgctgccgcagcagttgttacttattctgttggagcattaagtgcttttgacgctattggaggtgcttatgcagaaaatttacctgtaatcttaatctctggtgcacccaataacaacgatcacgctgctggtcatgtattgcatcatgctttaggtaaaaccgattatcattaccaattagaaatggcaaaaaatattaccgctgccgcagaagctatttatactcccgaagaagcacctgctaagatcgatcacgtaattaaaaccgctctccgtgagaaaaaacccgtatatttagaaatcgcttgcaatatcgcttctatgccttgtgcagctcctggacctgctagtgctttatttaacgatgaagcatctgatgaggctagtttaaatgccgctgttgaagaaactttgaaatttattgctaatcgtgataaagtagctgttttagttggttctaaactccgtgccgctggtgcagaagaagcggctgtaaaattcgcagatgccttaggaggtgctgttgccacaatggcagccgctaaaagttttttccccgaagaaaatcctcattacattggtacttcttggggtgaggtatcttaccctggtgtagaaaaaaccatgaaggaagctgatgcagtaattgcattagctcctgttttcaatgattactctaccactggttggactgatattccagaccccaaaaaattagttttagcagaacctcgctctgtagttgtgaatggtgttagatttcccagtgtacatctcaaagattatttaactcgtttagctcaaaaagtgagtaaaaagactggcgcactcgatttctttaaatctttaaatgctggtgaattaaagaaagcagctcctgctgatcccagtgctcctttagtgaatgccgaaatcgcaagacaagttgaagccttgttaactcctaacactaccgttattgccgagactggtgatagttggttcaatgctcaacgcatgaaattacccaatggtgctcgtgttgagtatgaaatgcaatggggtcacattggatggtctgttcctgctgcatttggatatgcagttggagcacctgagcgtagaaacattttaatggtaggtgatggttctttccaactcactgctcaagaagttgcacaaatggtacgtttaaaattgcctgttattatctttctcattaacaactatggttacaccattgaagttatgattcatgatggtccttataataacattaagaattgggattacgcaggtttaatggaggtatttaacggtaatggtggatacgacagtggagcaggtaaaggattaaaagctaaaacaggaggtgagttagctgaagcaattaaagtagctttagccaatacagatggtcctaccttaatcgaatgtttcattggacgtgaagattgtactgaagagttagttaaatggggaaagcgtgttgccgctgcaaattctcgtaaacctgtaaacaaactcttgtagttaggatccgagctcagcaagtttcatcccgaccccctcagggtcgggatttttttattgtactagttgacataagtaaaggcatcccctgcgtgatataattaccttcagtttaaggaggtatacacatatgattaaagcctacgctgccctggaagccaacggaaaactccaaccctttgaatacgaccccggtgccctgggtgctaatgaggtggagattgaggtgcagtattgtggggtgtgccacagtgatttgtccatgattaataacgaatggggcatttccaattaccccctagtgccgggtcatgaggtggtgggtactgtggccgccatgggcgaaggggtgaaccatgttgaggtgggggatttagtggggctgggttggcattcgggctactgcatgacctgccatagttgtttatctggctaccacaacctttgtgccacggcggaatcgaccattgtgggccactacggtggctttggcgatcgggttcgggccaagggagtcagcgtggtgaaattacctaaaggcattgacctagccagtgccgggccccttttctgtggaggaattaccgttttcagtcctatggtggaactgagtttaaagcccactgcaaaagtggcagtgatcggcattgggggcttgggccatttagcggtgcaatttctccgggcctggggctgtgaagtgactgcctttacctccagtgccaggaagcaaacggaagtgttggaattgggcgctcaccacatactagattccaccaatccagaggcgatcgccagtgcggaaggcaaatttgactatattatctccactgtgaacctgaagcttgactggaacttatacatcagcaccctggcgccccagggacatttccactttgttggggtggtgttggagcctttggatctaaatctttttccccttttgatgggacaacgctccgtttctgcctccccagtgggtagtcccgccaccattgccaccatgttggactttgctgtgcgccatgacattaaacccgtggtggaacaatttagctttgatcagatcaacgaggcgatcgcccatctagaaagcggcaaagcccattatcgggtagtgctcagccatagtaaaaattagctctgcaaaggttgcttctgggtccgtggaacgctcggttgccgccgggcgttttttattcctgcaggatcatcttgctgaaaaactcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgccctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttgaatatttttcgtcagatacgcaaaccttacaaacataattaacaactgaaactattgatatgtctaggttttagctctatcacaggttggatctg

SEQ ID NO: 74 - DNA, 12648 bp, Cyanobacterium sp. ABICyano1
tcgacaattaataacttcttcctgtacgggcgaatggccatttgctcctaactaactccgtactgctttgcggaacgagcgtagcgaactctccgaattactaagccttcatccctgatagatgcaaaaaacgcattaaaattatgcgtaaaaagcatatttgtctttatttagtaatcaaagttacaaattattaagaatcaaattaataatatattgggcagttaagtatataagtctttaaatatttatttgtattcaatatattaaccgaggacaaattatgaattcttacactgttggaacctatttagcagaacgtttagttcaaattggtctcaaacaccattttgcagtagctggtgattataatttagttttattggataacttattgttaaataagaatatggaacaagtgtattgttgtaatgaattaaactgtggtttttctgctgagggatatgctcgtgcaaaaggtgctgccgcagcagttgttacttattctgttggagcattaagtgcttttgacgctattggaggtgcttatgcagaaaatttacctgtaatcttaatctctggtgcacccaataacaacgatcacgctgctggtcatgtattgcatcatgctttaggtaaaaccgattatcattaccaattagaaatggcaaaaaatattaccgctgccgcagaagctatttatactcccgaagaagcacctgctaagatcgatcacgtaattaaaaccgctctccgtgagaaaaaacccgtatatttagaaatcgcttgcaatatcgcttctatgccttgtgcagctcctggacctgctagtgctttatttaacgatgaagcatctgatgaggctagtttaaatgccgctgttgaagaaactttgaaatttattgctaatcgtgataaagtagctgttttagttggttctaaactccgtgccgctggtgcagaagaagcggctgtaaaattcgcagatgccttaggaggtgctgttgccacaatggcagccgctaaaagttttttccccgaagaaaatcctcattacattggtacttcttggggtgaggtatcttaccctggtgtagaaaaaaccatgaaggaagctgatgcagtaattgcattagctcctgttttcaatgattactctaccactggttggactgatattccagaccccaaaaaattagttttagcagaacctcgctctgtagttgtgaatggtgttagatttcccagtgtacatctcaaagattatttaactcgtttagctcaaaaagtgagtaaaaagactggcgcactcgatttctttaaatctttaaatgctggtgaattaaagaaagcagctcctgctgatcccagtgctcctttagtgaatgccgaaatcgcaagacaagttgaagccttgttaactcctaacactaccgttattgccgagactggtgatagttggttcaatgctcaacgcatgaaattacccaatggtgctcgtgttgagtatgaaatgcaatggggtcacattggatggtctgttcctgctgcatttggatatgcagttggagcacctgagcgtagaaacattttaatggtaggtgatggttctttccaactcactgctcaagaagttgcacaaatggtacgtttaaaattgcctgttattatctttctcattaacaactatggttacaccattgaagttatgattcatgatggtccttataataacattaagaattgggattacgcaggtttaatggaggtatttaacggtaatggtggatacgacagtggagcaggtaaaggattaaaagctaaaacaggaggtgagttagctgaagcaattaaagtagctttagccaatacagatggtcctaccttaatcgaatgtttcattggacgtgaagattgtactgaagagttagttaaatggggaaagcgtgttgccgctgcaaattctcgtaaacctgtaaacaaactcttgtagttaggatccgagctcagcaagtttcatcccgaccccctcagggtcgggatttttttattgtactagttgacataagtaaaggcatcccctgcgtgatataattaccttcagtttaaggaggtatacacatatgattaaagcctacgctgccctggaagccaacggaaaactccaaccctttgaatacgaccccggtgccctgggtgctaatgaggtggagattgaggtgcagtattgtggggtgtgccacagtgatttgtccatgattaataacgaatggggcatttccaattaccccctagtgccgggtcatgaggtggtgggtactgtggccgccatgggcgaaggggtgaaccatgttgaggtgggggatttagtggggctgggttggcattcgggctactgcatgacctgccatagttgtttatctggctaccacaacctttgtgccacggcggaatcgaccattgtgggccactacggtggctttggcgatcgggttcgggccaagggagtcagcgtggtgaaattacctaaaggcattgacctagccagtgccgggccccttttctgtggaggaattaccgttttcagtcctatggtggaactgagtttaaagcccactgcaaaagtggcagtgatcggcattgggggcttgggccatttagcggtgcaatttctccgggcctggggctgtgaagtgactgcctttacctccagtgccaggaagcaaacggaagtgttggaattgggcgctcaccacatactagattccaccaatccagaggcgatcgccagtgcggaaggcaaatttgactatattatctccactgtgaacctgaagcttgactggaacttatacatcagcaccctggcgccccagggacatttccactttgttggggtggtgttggagcctttggatctaaatctttttccccttttgatgggacaacgctccgtttctgcctccccagtgggtagtcccgccaccattgccaccatgttggactttgctgtgcgccatgacattaaacccgtggtggaacaatttagctttgatcagatcaacgaggcgatcgcccatctagaaagcggcaaagcccattatcgggtagtgctcagccatagtaaaaattagctctgcaaaggttgcttctgggtccgtggaacgctcggttgccgccgggcgttttttattcctgcaggatcatcttgctgaaaaactcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgccctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttgaatatttttcgtcagatacgcaaaccttacaaacataattaacaactgaaactattgatatgtctaggttttagctctatcacaggttggatctg

SEQ ID NO: 75 - DNA, 12680 bp, Cyanobacterium sp. ABICyano1
tcgacaattaataacttcttcctgtacgggcgaatggccatttgctcctaactaactccgtactgctttgcggaacgagcgtagcgaactctccgaattactaagccttcatccctgatagatgcaaaaaacgaattaaaattatgtgtaaaaagaaaatgtgtctttatttagtagtcaaagttacaaaatattaagaatcaaattaataatgtattgggcagttaagtatataagtctttaaatatttatttgtattcaatatattaaccgaggacaaattatgaattcttataccgtgggtacttatttagccgaacgcttagtgcaaattggtttaaaacatcattttgccgtggctggggactataatttagtgttattggataacttattattaaataaaaacatggaacaagtgtattgttgtaatgaattaaattgtggtttttctgctgaaggttatgctagagctaaaggtgcagctgctgctgttgttacttattctgtgggtgctttatctgcttttgatgctattggtggtgcttatgccgaaaatttacccgtgattttaatttctggtgcccctaataataatgatcatgccgctggacatgttttacatcatgccttaggtaaaaccgattatcattatcaattagaaatggccaaaaatattactgctgctgccgaagctatttatactcctgaagaagcccctgccaaaattgatcatgtgattaaaaccgccttacgcgaaaaaaaacccgtgtatttagaaattgcctgtaatattgcttctatgccttgtgctgctcctgggcctgcttctgctttatttaatgatgaagcctctgatgaagctagtttaaatgctgccgtggaagaaaccttaaaatttattgccaatcgcgataaagttgccgtgttagttggttctaaattaagagctgctggtgctgaagaagctgctgttaaatttgctgatgctttaggtggtgcagttgctactatggctgctgccaaatctttttttcccgaagaaaatccccattatattggaactagttggggagaagtttcttatcctggtgtggaaaaaactatgaaagaagccgacgctgttattgctttagcccctgtgtttaatgattattctaccactggttggactgatattcccgatcccaaaaaattagttttagccgaacctcgttctgttgttgttaatggtgttcgctttccctctgtgcatttaaaagattatttaacccgcttagcccaaaaagtttctaaaaaaactggtgccttagatttttttaaatctttaaatgcgggtgaattaaaaaaagctgctcctgctgatccttctgctcctttagttaatgctgaaattgcccgtcaagttgaagccttattaacccctaatactaccgttattgccgaaactggtgattcttggtttaatgcccaacgcatgaaattacctaatggtgcccgtgttgaatatgaaatgcaatggggtcatattggttggtctgtacctgctgcttttggttatgctgttggtgctcctgaacgtcgtaatattttaatggtgggtgatggttcttttcaattaactgcccaagaagttgcccaaatggttcgcttaaaattacccgttattatttttttaataaataattatggttataccattgaagtgatgattcatgatgggccatataataatattaaaaattgggattatgcgggtttaatggaagtgtttaatggtaatggtggttatgattctggtgctggtaaaggtttaaaagccaaaactggtggtgaattagctgaagctattaaagttgccttagccaatactgatgggccaaccttaattgaatgttttattggtcgcgaagattgtaccgaagaattagttaaatggggtaaacgtgttgctgctgctaattctcgcaaacccgtgaataaattattgtaatttttggggatcaattcgagctcagcaagtttcatcccgaccccctcagggtcgggatttttttattgtactagttgacataagtaaaggcatcccctgcgtgatataattaccttcagtttaaggaggtatacacatatgagtgaaactaaatttaaagcctatgccgtaatgaatcctggtgaaaaattacaaccctgggaatatgaacctgctcctttacaggtagatgaaattgaagtaagagttactcacaatggtttatgtcacactgacttacacatgagagataatgactggaatgttagtgagttccccttagtagcaggtcatgaagttgttggtgaagtaaccgctgttggtgaaaaagtaaccagtcgtaaaaaaggtgatagagttggtgtaggttggattcgtaattcttgtcgcgcttgtgaccattgtttacaaggagaagagaacatttgtagagagggttatactggtttaattgttggtcatcacggtggatttgctgatcgtgtacgtgtacctgctgacttcacttataaaattcctgatgctttagatagtgcatctgctgctcctttattatgtgccggtattaccgtttacactcctttaagaacctacattaaacatcccggtatgaaagtaggtgttatgggtattggaggattaggacatttagctattaaatttgctcgtgcaatgggagcagaagttactgcctttagtaccagtcctaataaagaagcccaagccaaagaatttggtgctcatcatttccaacaatggggtactgctgaagaaatgaaagctgttgccggtaattttgatttagttttatctaccatctctgctgaaactgactgggatgctgccttctctttattagcaaataacggtgttttatgtttcgtaggtattcccgttagttctttaaatgttcctttaattcctttaattttcggacaaaaatctgttgtaggttctgtagttggaggaagaagattcatggcagaaatgttagagttcgccgctgtaaatcagattaaacctatgatcgaaactatgcccttatctcaagtaaatgaagctatggataaagttgccgccaataaagccagatatagaattgtattattatctgaataactagatctcctgcagagaatataaaaagccagattattaatccggcttttttattatttaaatactgtgcacgatcctgcaggatcatcttgctgaaaaactcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgccctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttgaatatttttcgtcagatacgcaaaccttacaaacataattaacaactgaaactattgatatgtctaggttttagctctatcacaggttggatctg

SEQ ID NO: 76 - DNA, 12525 bp, Cyanobacterium sp. ABICyano1
tcgacaattttatggttgtttgtaaaatatattaacaaatgaacaataattcatttgttgtgttaatctaattattagacaattactgaatttatattcagtaattcacagataggaggatcagccatatgaattcttataccgtgggtacttatttagccgaacgcttagtgcaaattggtttaaaacatcattttgccgtggctggggactataatttagtgttattggataacttattattaaataaaaacatggaacaagtgtattgttgtaatgaattaaattgtggtttttctgctgaaggttatgctagagctaaaggtgcagctgctgctgttgttacttattctgtgggtgctttatctgcttttgatgctattggtggtgcttatgccgaaaatttacccgtgattttaatttctggtgcccctaataataatgatcatgccgctggacatgttttacatcatgccttaggtaaaaccgattatcattatcaattagaaatggccaaaaatattactgctgctgccgaagctatttatactcctgaagaagcccctgccaaaattgatcatgtgattaaaaccgccttacgcgaaaaaaaacccgtgtatttagaaattgcctgtaatattgcttctatgccttgtgctgctcctgggcctgcttctgctttatttaatgatgaagcctctgatgaagctagtttaaatgctgccgtggaagaaaccttaaaatttattgccaatcgcgataaagttgccgtgttagttggttctaaattaagagctgctggtgctgaagaagctgctgttaaatttgctgatgctttaggtggtgcagttgctactatggctgctgccaaatctttttttcccgaagaaaatccccattatattggaactagttggggagaagtttcttatcctggtgtggaaaaaactatgaaagaagccgacgctgttattgctttagcccctgtgtttaatgattattctaccactggttggactgatattcccgatcccaaaaaattagttttagccgaacctcgttctgttgttgttaatggtgttcgctttccctctgtgcatttaaaagattatttaacccgcttagcccaaaaagtttctaaaaaaactggtgccttagatttttttaaatctttaaatgcgggtgaattaaaaaaagctgctcctgctgatccttctgctcctttagttaatgctgaaattgcccgtcaagttgaagccttattaacccctaatactaccgttattgccgaaactggtgattcttggtttaatgcccaacgcatgaaattacctaatggtgcccgtgttgaatatgaaatgcaatggggtcatattggttggtctgtacctgctgcttttggttatgctgttggtgctcctgaacgtcgtaatattttaatggtgggtgatggttcttttcaattaactgcccaagaagttgcccaaatggttcgcttaaaattacccgttattatttttttaataaataattatggttataccattgaagtgatgattcatgatgggccatataataatattaaaaattgggattatgcgggtttaatggaagtgtttaatggtaatggtggttatgattctggtgctggtaaaggtttaaaagccaaaactggtggtgaattagctgaagctattaaagttgccttagccaatactgatgggccaaccttaattgaatgttttattggtcgcgaagattgtaccgaagaattagttaaatggggtaaacgtgttgctgctgctaattctcgcaaacccgtgaataaattattgtaatttttggggatcaattcgagctcagcaagtttcatcccgaccccctcagggtcgggatttttttattgtactagttgacataagtaaaggcatcccctgcgtgatataattaccttcagtttaaggaggtatacacatatgagtgaaactaaatttaaagcctatgccgtaatgaatcctggtgaaaaattacaaccctgggaatatgaacctgctcctttacaggtagatgaaattgaagtaagagttactcacaatggtttatgtcacactgacttacacatgagagataatgactggaatgttagtgagttccccttagtagcaggtcatgaagttgttggtgaagtaaccgctgttggtgaaaaagtaaccagtcgtaaaaaaggtgatagagttggtgtaggttggattcgtaattcttgtcgcgcttgtgaccattgtttacaaggagaagagaacatttgtagagagggttatactggtttaattgttggtcatcacggtggatttgctgatcgtgtacgtgtacctgctgacttcacttataaaattcctgatgctttagatagtgcatctgctgctcctttattatgtgccggtattaccgtttacactcctttaagaacctacattaaacatcccggtatgaaagtaggtgttatgggtattggaggattaggacatttagctattaaatttgctcgtgcaatgggagcagaagttactgcctttagtaccagtcctaataaagaagcccaagccaaagaatttggtgctcatcatttccaacaatggggtactgctgaagaaatgaaagctgttgccggtaattttgatttagttttatctaccatctctgctgaaactgactgggatgctgccttctctttattagcaaataacggtgttttatgtttcgtaggtattcccgttagttctttaaatgttcctttaattcctttaattttcggacaaaaatctgttgtaggttctgtagttggaggaagaagattcatggcagaaatgttagagttcgccgctgtaaatcagattaaacctatgatcgaaactatgcccttatctcaagtaaatgaagctatggataaagttgccgccaataaagccagatatagaattgtattattatctgaataactagatctcctgcagagaatataaaaagccagattattaatccggcttttttattatttaaatactgtgcacgatcctgcaggatcatcttgctgaaaaactcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgccctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttgaatatttttcgtcagatacgcaaaccttacaaacataattaacaactgaaactattgatatgtctaggttttagctctatcacaggttggatctg

SEQ ID NO: 77 - DNA, 12678 bp, Cyanobacterium sp. ABICyano1
tcgacaattaataacttcttcctgtacgggcgaatggccatttgctcctaactaactccgtactgctttgcggaacgagcgtagcgaactctccgaattactaagccttcatccctgatagatgcaaaaaacgaattaaaattatgtgtaaaaagaaaatgtgtctttatttagtagtcaaagttacaaaatattaagaatcaaattaataatgtattgggcagttaagtatataagtctttaaatatttatttgtattcaatatattaaccgaggacaaattatgaattcttataccgtgggtacttatttagccgaacgcttagtgcaaattggtttaaaacatcattttgccgtggctggggactataatttagtgttattggataacttattattaaataaaaacatggaacaagtgtattgttgtaatgaattaaattgtggtttttctgctgaaggttatgctagagctaaaggtgcagctgctgctgttgttacttattctgtgggtgctttatctgcttttgatgctattggtggtgcttatgccgaaaatttacccgtgattttaatttctggtgcccctaataataatgatcatgccgctggacatgttttacatcatgccttaggtaaaaccgattatcattatcaattagaaatggccaaaaatattactgctgctgccgaagctatttatactcctgaagaagcccctgccaaaattgatcatgtgattaaaaccgccttacgcgaaaaaaaacccgtgtatttagaaattgcctgtaatattgcttctatgccttgtgctgctcctgggcctgcttctgctttatttaatgatgaagcctctgatgaagctagtttaaatgctgccgtggaagaaaccttaaaatttattgccaatcgcgataaagttgccgtgttagttggttctaaattaagagctgctggtgctgaagaagctgctgttaaatttgctgatgctttaggtggtgcagttgctactatggctgctgccaaatctttttttcccgaagaaaatccccattatattggaactagttggggagaagtttcttatcctggtgtggaaaaaactatgaaagaagccgacgctgttattgctttagcccctgtgtttaatgattattctaccactggttggactgatattcccgatcccaaaaaattagttttagccgaacctcgttctgttgttgttaatggtgttcgctttccctctgtgcatttaaaagattatttaacccgcttagcccaaaaagtttctaaaaaaactggtgccttagatttttttaaatctttaaatgcgggtgaattaaaaaaagctgctcctgctgatccttctgctcctttagttaatgctgaaattgcccgtcaagttgaagccttattaacccctaatactaccgttattgccgaaactggtgattcttggtttaatgcccaacgcatgaaattacctaatggtgcccgtgttgaatatgaaatgcaatggggtcatattggttggtctgtacctgctgcttttggttatgctgttggtgctcctgaacgtcgtaatattttaatggtgggtgatggttcttttcaattaactgcccaagaagttgcccaaatggttcgcttaaaattacccgttattatttttttaataaataattatggttataccattgaagtgatgattcatgatgggccatataataatattaaaaattgggattatgcgggtttaatggaagtgtttaatggtaatggtggttatgattctggtgctggtaaaggtttaaaagccaaaactggtggtgaattagctgaagctattaaagttgccttagccaatactgatgggccaaccttaattgaatgttttattggtcgcgaagattgtaccgaagaattagttaaatggggtaaacgtgttgctgctgctaattctcgcaaacccgtgaataaattattgtaatttttggggatcaattcgagctcagcaagtttcatcccgaccccctcagggtcgggatttttttattgtactagttgacataagtaaaggcatcccctgcgtgatataattaccttcagtttaaggaggtatacacatatgtctgaaactaaatttaaggcctatgccgttatgaatcccggcgaaaagctgcaaccctgggaatacgaaccggcgccgctgcaagtggatgaaattgaagtgcgggtgactcacaacggcctttgtcacaccgacctgcacatgagggacaatgactggaacgtgagcgaatttcccctcgttgccggccacgaagtcgttggagaagtgacggcagtcggggaaaaagtcacttcacgaaagaaaggcgatcgcgtgggggtgggttggatcagaaactcctgtcgggcctgcgatcattgtttgcaaggggaagaaaatatctgtcgcgaaggctatacaggtctgatcgtcgggcatcacggcggatttgccgatcgcgttcgggttccggccgatttcacctacaaaattcccgacgccttggactccgcgagtgccgcgccgctgctgtgtgccggcatcaccgtctacacccccctgcggacttatatcaaacacccggggatgaaagtcggggtgatgggaatcggcggactcggacatttagcgatcaaatttgcccgggcgatgggggcggaagtcacggctttttccacatccccgaataaagaagcccaagccaaggaatttggcgcccatcatttccaacagtggggaacagccgaagaaatgaaagcggtggccggaaatttcgatttggtgctttccaccatctccgccgaaactgattgggatgcggcgttcagtttgctggcaaataacggggttttgtgtttcgtcggcattccggtttccagtttgaacgtgccgctgattccgctgattttcggtcaaaaatccgtcgtcggcagcgtagtgggcggccggcggttcatggcagaaatgttggaatttgccgccgtgaatcagatcaaaccgatgatcgaaacgatgccgttgagtcaggtgaacgaggcgatggacaaggtagcggcgaataaagctcgctatcggatcgtgttgctttcggagtgaagatctcctgcagagaatataaaaagccagattattaatccggcttttttattatttaaatactgtgcacgatcctgcaggatcatcttgctgaaaaactcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgccctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttgaatatttttcgtcagatacgcaaaccttacaaacataattaacaactgaaactattgatatgtctaggttttagctctatcacaggttggatctg

SEQ ID NO: 78 - DNA, 12683 bp, Cyanobacterium sp. ABICyano1
tcgacaattaataacttcttcctgtacgggcgaatggccatttgctcctaactaactccgtactgctttgcggaacgagcgtagcgaactctccgaattactaagccttcatccctgatagatgcaaaaaacgaattaaaattatgtgtaaaaagaaaatgtgtctttatttagtagtcaaagttacaaaatattaagaatcaaattaataatgtattgggcagttaagtatataagtctttaaatatttatttgtattcaatatattaaccgaggacaaattatgaattcttataccgtgggtacttatttagccgaacgcttagtgcaaattggtttaaaacatcattttgccgtggctggggactataatttagtgttattggataacttattattaaataaaaacatggaacaagtgtattgttgtaatgaattaaattgtggtttttctgctgaaggttatgctagagctaaaggtgcagctgctgctgttgttacttattctgtgggtgctttatctgcttttgatgctattggtggtgcttatgccgaaaatttacccgtgattttaatttctggtgcccctaataataatgatcatgccgctggacatgttttacatcatgccttaggtaaaaccgattatcattatcaattagaaatggccaaaaatattactgctgctgccgaagctatttatactcctgaagaagcccctgccaaaattgatcatgtgattaaaaccgccttacgcgaaaaaaaacccgtgtatttagaaattgcctgtaatattgcttctatgccttgtgctgctcctgggcctgcttctgctttatttaatgatgaagcctctgatgaagctagtttaaatgctgccgtggaagaaaccttaaaatttattgccaatcgcgataaagttgccgtgttagttggttctaaattaagagctgctggtgctgaagaagctgctgttaaatttgctgatgctttaggtggtgcagttgctactatggctgctgccaaatctttttttcccgaagaaaatccccattatattggaactagttggggagaagtttcttatcctggtgtggaaaaaactatgaaagaagccgacgctgttattgctttagcccctgtgtttaatgattattctaccactggttggactgatattcccgatcccaaaaaattagttttagccgaacctcgttctgttgttgttaatggtgttcgctttccctctgtgcatttaaaagattatttaacccgcttagcccaaaaagtttctaaaaaaactggtgccttagatttttttaaatctttaaatgcgggtgaattaaaaaaagctgctcctgctgatccttctgctcctttagttaatgctgaaattgcccgtcaagttgaagccttattaacccctaatactaccgttattgccgaaactggtgattcttggtttaatgcccaacgcatgaaattacctaatggtgcccgtgttgaatatgaaatgcaatggggtcatattggttggtctgtacctgctgcttttggttatgctgttggtgctcctgaacgtcgtaatattttaatggtgggtgatggttcttttcaattaactgcccaagaagttgcccaaatggttcgcttaaaattacccgttattatttttttaataaataattatggttataccattgaagtgatgattcatgatgggccatataataatattaaaaattgggattatgcgggtttaatggaagtgtttaatggtaatggtggttatgattctggtgctggtaaaggtttaaaagccaaaactggtggtgaattagctgaagctattaaagttgccttagccaatactgatgggccaaccttaattgaatgttttattggtcgcgaagattgtaccgaagaattagttaaatggggtaaacgtgttgctgctgctaattctcgcaaacccgtgaataaattattgtaatttttggggatcaattcgagctcagcaagtttcatcccgaccccctcagggtcgggatttttttattgtactagttgacataagtaaaggcatcccctgcgtgatataattaccttcagtttaaggaggtatacacatatgactaccgctactaaatttaaagcatacgccgcattaaattctggtgaaaaattacagccctgggaatacgaacctgaacctttacaggttgatgaggttgagatccgtgtaacccataacggtttatgtcatactgatttacacatgcgtgataatgattggaacgtaagtcaatatcctttagtacccggtcacgaagtagttggtgaggttaccgaggttggtgaaaaagtaaccagtttacacaaaggagacagaattggtgtaggatggattagaaattcttgtcgttcttgtgatcactgtttacaaggagaggaaaacatctgtcgtgaaggatacactggtttaattgttggacaccacggtggtttcgctgatcgtttacgtgtacctgctgatttcacctacaaaattcctgatgcattagattctgcctctgccgctcccttattatgtgctggtattactgtttatacccccttaagaacttacatcaaacaccccggtatgaaagttggtgtaatgggaattggtggtttaggtcatttagctattaaatttgctagagctatgggagctgaagtaactgcattttctacttctttaaacaaacaagaacaggcaaaagagtttggagcacacaattttcagcaatggggaactgctgaagagatgaaagctattgctggttctttcgatttagttttatctactatctctagtgaaactgattgggatgctgctttctctttattagctaacaatggtgtattatgttttgttggtattcctgtttctaccttaaatattcctttaatccctttaatctttggtcaaaaagctgtagtaggaagtattgttggtggaagacgttttatggctgagatgttagaatttgctgccgttaatcagatcaaacccatgattgagactatgcctttaagtcaaatcaacgaggctatggataaagttgcagctaatcaagcccgttatcgtattgtattattagcagactaactagatctcctgcagagaatataaaaagccagattattaatccggcttttttattatttaaatactgtgcacgatcctgcaggatcatcttgctgaaaaactcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgccctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttgaatatttttcgtcagatacgcaaaccttacaaacataattaacaactgaaactattgatatgtctaggttttagctctatcacaggttggatctg

SEQ ID NO: 79 - DNA, 12683 bp, Cyanobacterium sp. ABICyano1
tcgacaattaataacttcttcctgtacgggcgaatggccatttgctcctaactaactccgtactgctttgcggaacgagcgtagcgaactctccgaattactaagccttcatccctgatagatgcaaaaaacgaattaaaattatgtgtaaaaagaaaatgtgtctttatttagtagtcaaagttacaaaatattaagaatcaaattaataatgtattgggcagttaagtatataagtctttaaatatttatttgtattcaatatattaaccgaggacaaattatgaattcttataccgtgggtacttatttagccgaacgcttagtgcaaattggtttaaaacatcattttgccgtggctggggactataatttagtgttattggataacttattattaaataaaaacatggaacaagtgtattgttgtaatgaattaaattgtggtttttctgctgaaggttatgctagagctaaaggtgcagctgctgctgttgttacttattctgtgggtgctttatctgcttttgatgctattggtggtgcttatgccgaaaatttacccgtgattttaatttctggtgcccctaataataatgatcatgccgctggacatgttttacatcatgccttaggtaaaaccgattatcattatcaattagaaatggccaaaaatattactgctgctgccgaagctatttatactcctgaagaagcccctgccaaaattgatcatgtgattaaaaccgccttacgcgaaaaaaaacccgtgtatttagaaattgcctgtaatattgcttctatgccttgtgctgctcctgggcctgcttctgctttatttaatgatgaagcctctgatgaagctagtttaaatgctgccgtggaagaaaccttaaaatttattgccaatcgcgataaagttgccgtgttagttggttctaaattaagagctgctggtgctgaagaagctgctgttaaatttgctgatgctttaggtggtgcagttgctactatggctgctgccaaatctttttttcccgaagaaaatccccattatattggaactagttggggagaagtttcttatcctggtgtggaaaaaactatgaaagaagccgacgctgttattgctttagcccctgtgtttaatgattattctaccactggttggactgatattcccgatcccaaaaaattagttttagccgaacctcgttctgttgttgttaatggtgttcgctttccctctgtgcatttaaaagattatttaacccgcttagcccaaaaagtttctaaaaaaactggtgccttagatttttttaaatctttaaatgcgggtgaattaaaaaaagctgctcctgctgatccttctgctcctttagttaatgctgaaattgcccgtcaagttgaagccttattaacccctaatactaccgttattgccgaaactggtgattcttggtttaatgcccaacgcatgaaattacctaatggtgcccgtgttgaatatgaaatgcaatggggtcatattggttggtctgtacctgctgcttttggttatgctgttggtgctcctgaacgtcgtaatattttaatggtgggtgatggttcttttcaattaactgcccaagaagttgcccaaatggttcgcttaaaattacccgttattatttttttaataaataattatggttataccattgaagtgatgattcatgatgggccatataataatattaaaaattgggattatgcgggtttaatggaagtgtttaatggtaatggtggttatgattctggtgctggtaaaggtttaaaagccaaaactggtggtgaattagctgaagctattaaagttgccttagccaatactgatgggccaaccttaattgaatgttttattggtcgcgaagattgtaccgaagaattagttaaatggggtaaacgtgttgctgctgctaattctcgcaaacccgtgaataaattattgtaatttttggggatcaattcgagctcagcaagtttcatcccgaccccctcagggtcgggatttttttattgtactagttgacataagtaaaggcatcccctgcgtgatataattaccttcagtttaaggaggtatacacatatgactacagcaactaaatttaaggcttatgcggctttaaattccggtgaaaaattgcaaccttgggaatatgaaccagaacctctacaggttgatgaagtagaaattcgagtcactcacaacggcttgtgtcatacggatcttcacatgagggataatgattggaatgtcagtcaatatcccctggttcccggtcatgaagtggttggagaagttacagaagttggggaaaaagtgacttctctacataaaggcgatcgcataggggttggctggattagaaattcctgtaggtcttgcgaccattgcttacaaggagaagaaaatatctgtcgcgagggctacacaggtctgattgtaggtcatcatgggggatttgctgaccgcctacgggttcccgcagattttacctataaaatacccgatgctttagactccgccagcgccgcccccctattatgtgccggaattaccgtttatacccccttgcggacctatataaaacaccccgggatgaaagttggggtgatgggaattggcggactcggacacttagcgattaagtttgctagggctatgggggctgaagttacggcgttttctacttctttaaataaacaagaacaagctaaggaatttggcgctcataacttccaacaatgggggacggctgaagaaatgaaggcgatcgccggaagttttgatctagtgctttctactatctcttcagaaactgattgggatgcggcttttagcttgttagctaataacggggttttgtgttttgtgggtatcccagtttcgactttaaatatacccctaattcctttgatttttggtcaaaaagctgtggtgggtagcattgtcggcggtcggcggtttatggcggaaatgctggagtttgcagcggtgaatcagattaaaccgatgattgaaactatgccattaagtcaaatcaatgaagctatggataaggtagccgctaatcaagcccgctatcggattgttttactagctgattagccagatctcctgcagagaatataaaaagccagattattaatccggcttttttattatttaaatactgtgcacgatcctgcaggatcatcttgctgaaaaactcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgccctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttgaatatttttcgtcagatacgcaaaccttacaaacataattaacaactgaaactattgatatgtctaggttttagctctatcacaggttggatctg

SEQ ID NO: 80 - DNA, 12698 bp, Cyanobacterium sp. ABICyano1
tcgacaattaataacttcttcctgtacgggcgaatggccatttgctcctaactaactccgtactgctttgcggaacgagcgtagcgaactctccgaattactaagccttcatccctgatagatgcaaaaaacgaattaaaattatgtgtaaaaagaaaatgtgtctttatttagtagtcaaagttacaaaatattaagaatcaaattaataatgtattgggcagttaagtatataagtctttaaatatttatttgtattcaatatattaaccgaggacaaattatgaattcttacactgttggaacctatttagcagaacgtttagttcaaattggtctcaaacaccattttgcagtagctggtgattataatttagttttattggataacttattgttaaataagaatatggaacaagtgtattgttgtaatgaattaaactgtggtttttctgctgagggatatgctcgtgcaaaaggtgctgccgcagcagttgttacttattctgttggagcattaagtgcttttgacgctattggaggtgcttatgcagaaaatttacctgtaatcttaatctctggtgcacccaataacaacgatcacgctgctggtcatgtattgcatcatgctttaggtaaaaccgattatcattaccaattagaaatggcaaaaaatattaccgctgccgcagaagctatttatactcccgaagaagcacctgctaagatcgatcacgtaattaaaaccgctctccgtgagaaaaaacccgtatatttagaaatcgcttgcaatatcgcttctatgccttgtgcagctcctggacctgctagtgctttatttaacgatgaagcatctgatgaggctagtttaaatgccgctgttgaagaaactttgaaatttattgctaatcgtgataaagtagctgttttagttggttctaaactccgtgccgctggtgcagaagaagcggctgtaaaattcgcagatgccttaggaggtgctgttgccacaatggcagccgctaaaagttttttccccgaagaaaatcctcattacattggtacttcttggggtgaggtatcttaccctggtgtagaaaaaaccatgaaggaagctgatgcagtaattgcattagctcctgttttcaatgattactctaccactggttggactgatattccagaccccaaaaaattagttttagcagaacctcgctctgtagttgtgaatggtgttagatttcccagtgtacatctcaaagattatttaactcgtttagctcaaaaagtgagtaaaaagactggcgcactcgatttctttaaatctttaaatgctggtgaattaaagaaagcagctcctgctgatcccagtgctcctttagtgaatgccgaaatcgcaagacaagttgaagccttgttaactcctaacactaccgttattgccgagactggtgatagttggttcaatgctcaacgcatgaaattacccaatggtgctcgtgttgagtatgaaatgcaatggggtcacattggatggtctgttcctgctgcatttggatatgcagttggagcacctgagcgtagaaacattttaatggtaggtgatggttctttccaactcactgctcaagaagttgcacaaatggtacgtttaaaattgcctgttattatctttctcattaacaactatggttacaccattgaagttatgattcatgatggtccttataataacattaagaattgggattacgcaggtttaatggaggtatttaacggtaatggtggatacgacagtggagcaggtaaaggattaaaagctaaaacaggaggtgagttagctgaagcaattaaagtagctttagccaatacagatggtcctaccttaatcgaatgtttcattggacgtgaagattgtactgaagagttagttaaatggggaaagcgtgttgccgctgcaaattctcgtaaacctgtaaacaaactcttgtagttaggatccagcaaggtttcatcccgaccccctcagggtcgggatttttttattgtgagctcagaaaaactattgacaaacccataaaaaatgtgatataattatagattgtcactggtattttatactagaggcaaattatatttatatatacaaaaatgctgtaggaggatcagccatatgattaaagcctacgctgccctggaagccaacggaaaactccaaccctttgaatacgaccccggtgccctgggtgctaatgaggtggagattgaggtgcagtattgtggggtgtgccacagtgatttgtccatgattaataacgaatggggcatttccaattaccccctagtgccgggtcatgaggtggtgggtactgtggccgccatgggcgaaggggtgaaccatgttgaggtgggggatttagtggggctgggttggcattcgggctactgcatgacctgccatagttgtttatctggctaccacaacctttgtgccacggcggaatcgaccattgtgggccactacggtggctttggcgatcgggttcgggccaagggagtcagcgtggtgaaattacctaaaggcattgacctagccagtgccgggccccttttctgtggaggaattaccgttttcagtcctatggtggaactgagtttaaagcccactgcaaaagtggcagtgatcggcattgggggcttgggccatttagcggtgcaatttctccgggcctggggctgtgaagtgactgcctttacctccagtgccaggaagcaaacggaagtgttggaattgggcgctcaccacatactagattccaccaatccagaggcgatcgccagtgcggaaggcaaatttgactatattatctccactgtgaacctgaagcttgactggaacttatacatcagcaccctggcgccccagggacatttccactttgttggggtggtgttggagcctttggatctaaatctttttccccttttgatgggacaacgctccgtttctgcctccccagtgggtagtcccgccaccattgccaccatgttggactttgctgtgcgccatgacattaaacccgtggtggaacaatttagctttgatcagatcaacgaggcgatcgcccatctagaaagcggcaaagcccattatcgggtagtgctcagccatagtaaaaattagctctgcaaaggttgcttctagatctgtggaacgcccggttgccaccgggcgttttttattcctgcaggatcatcttgctgaaaaactcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgccctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttgaatatttttcgtcagatacgcaaaccttacaaacataattaacaactgaaactattgatatgtctaggttttagctctatcacaggttggatctg

SEQ ID NO: 81 - DNA, 13085 bp, Cyanobacterium sp. ABICyano1
tcgacaattaataacttcttcctgtacgggcgaatggccatttgctcctaactaactccgtactgctttgcggaacgagcgtagcgaactctccgaattactaagccttcatccctgatagatgcaaaaaacgaattaaaattatgtgtaaaaagaaaatgtgtctttatttagtagtcaaagttacaaaatattaagaatcaaattaataatgtattgggcagttaagtatataagtctttaaatatttatttgtattcaatatattaaccgaggacaaattatgaattcttacactgttggaacctatttagcagaacgtttagttcaaattggtctcaaacaccattttgcagtagctggtgattataatttagttttattggataacttattgttaaataagaatatggaacaagtgtattgttgtaatgaattaaactgtggtttttctgctgagggatatgctcgtgcaaaaggtgctgccgcagcagttgttacttattctgttggagcattaagtgcttttgacgctattggaggtgcttatgcagaaaatttacctgtaatcttaatctctggtgcacccaataacaacgatcacgctgctggtcatgtattgcatcatgctttaggtaaaaccgattatcattaccaattagaaatggcaaaaaatattaccgctgccgcagaagctatttatactcccgaagaagcacctgctaagatcgatcacgtaattaaaaccgctctccgtgagaaaaaacccgtatatttagaaatcgcttgcaatatcgcttctatgccttgtgcagctcctggacctgctagtgctttatttaacgatgaagcatctgatgaggctagtttaaatgccgctgttgaagaaactttgaaatttattgctaatcgtgataaagtagctgttttagttggttctaaactccgtgccgctggtgcagaagaagcggctgtaaaattcgcagatgccttaggaggtgctgttgccacaatggcagccgctaaaagttttttccccgaagaaaatcctcattacattggtacttcttggggtgaggtatcttaccctggtgtagaaaaaaccatgaaggaagctgatgcagtaattgcattagctcctgttttcaatgattactctaccactggttggactgatattccagaccccaaaaaattagttttagcagaacctcgctctgtagttgtgaatggtgttagatttcccagtgtacatctcaaagattatttaactcgtttagctcaaaaagtgagtaaaaagactggcgcactcgatttctttaaatctttaaatgctggtgaattaaagaaagcagctcctgctgatcccagtgctcctttagtgaatgccgaaatcgcaagacaagttgaagccttgttaactcctaacactaccgttattgccgagactggtgatagttggttcaatgctcaacgcatgaaattacccaatggtgctcgtgttgagtatgaaatgcaatggggtcacattggatggtctgttcctgctgcatttggatatgcagttggagcacctgagcgtagaaacattttaatggtaggtgatggttctttccaactcactgctcaagaagttgcacaaatggtacgtttaaaattgcctgttattatctttctcattaacaactatggttacaccattgaagttatgattcatgatggtccttataataacattaagaattgggattacgcaggtttaatggaggtatttaacggtaatggtggatacgacagtggagcaggtaaaggattaaaagctaaaacaggaggtgagttagctgaagcaattaaagtagctttagccaatacagatggtcctaccttaatcgaatgtttcattggacgtgaagattgtactgaagagttagttaaatggggaaagcgtgttgccgctgcaaattctcgtaaacctgtaaacaaactcttgtagttaggatccagcaaggtttcatcccgaccccctcagggtcgggatttttttattgtgagctcaactttagatattcgtagttggcaatgtcgtaaatgcggaacaatacatggaaaacatatagatttgtaatgagaaaaagtgtaaacaaatattaagaaaaagatcagaaaaatttaacaacacgtaataaaaaaatgcgtcactacgggttataaatttacatgaaaggttaaaacacttttctgagacgattttgataaaaaagttgtcaaaaaattaagtttctttacaaatgcttaacaaaaacttggttttaagcacaaaataagagagactaatttgcagaagttttacaaggaaatcttgaagaaaaagatctaagtaaaacgactctgtttaaccaaaatttaacaaatttaacaaaacaaactaaatctattaggagattaactacatatgactaccgctactaaatttaaagcatacgccgcattaaattctggtgaaaaattacagccctgggaatacgaacctgaacctttacaggttgatgaggttgagatccgtgtaacccataacggtttatgtcatactgatttacacatgcgtgataatgattggaacgtaagtcaatatcctttagtacccggtcacgaagtagttggtgaggttaccgaggttggtgaaaaagtaaccagtttacacaaaggagacagaattggtgtaggatggattagaaattcttgtcgttcttgtgatcactgtttacaaggagaggaaaacatctgtcgtgaaggatacactggtttaattgttggacaccacggtggtttcgctgatcgtttacgtgtacctgctgatttcacctacaaaattcctgatgcattagattctgcctctgccgctcccttattatgtgctggtattactgtttatacccccttaagaacttacatcaaacaccccggtatgaaagttggtgtaatgggaattggtggtttaggtcatttagctattaaatttgctagagctatgggagctgaagtaactgcattttctacttctttaaacaaacaagaacaggcaaaagagtttggagcacacaattttcagcaatggggaactgctgaagagatgaaagctattgctggttctttcgatttagttttatctactatctctagtgaaactgattgggatgctgctttctctttattagctaacaatggtgtattatgttttgttggtattcctgtttctaccttaaatattcctttaatccctttaatctttggtcaaaaagctgtagtaggaagtattgttggtggaagacgttttatggctgagatgttagaatttgctgccgttaatcagatcaaacccatgattgagactatgcctttaagtcaaatcaacgaggctatggataaagttgcagctaatcaagcccgttatcgtattgtattattagcagactaactagatctacttctaaactgaaacaaatttgagggtaggcttcattgtctgcccttatttttttatttaggaaaagtgaacagactaaagagtgttggctctattgctttgagtatgtaaattaggcgttgctgaattaaggtatgatttttgacccctgcaggatcatcttgctgaaaaactcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgccctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttgaatatttttcgtcagatacgcaaaccttacaaacataattaacaactgaaactattgatatgtctaggttttagctctatcacaggttggatctg

SEQ ID NO: 82 - DNA, 13082 bp, Cyanobacterium sp. ABICyano1
tcgacaattaataacttcttcctgtacgggcgaatggccatttgctcctaactaactccgtactgctttgcggaacgagcgtagcgaactctccgaattactaagccttcatccctgatagatgcaaaaaacgaattaaaattatgtgtaaaaagaaaatgtgtctttatttagtagtcaaagttacaaaatattaagaatcaaattaataatgtattgggcagttaagtatataagtctttaaatatttatttgtattcaatatattaaccgaggacaaattatgaattcttacactgttggaacctatttagcagaacgtttagttcaaattggtctcaaacaccattttgcagtagctggtgattataatttagttttattggataacttattgttaaataagaatatggaacaagtgtattgttgtaatgaattaaactgtggtttttctgctgagggatatgctcgtgcaaaaggtgctgccgcagcagttgttacttattctgttggagcattaagtgcttttgacgctattggaggtgcttatgcagaaaatttacctgtaatcttaatctctggtgcacccaataacaacgatcacgctgctggtcatgtattgcatcatgctttaggtaaaaccgattatcattaccaattagaaatggcaaaaaatattaccgctgccgcagaagctatttatactcccgaagaagcacctgctaagatcgatcacgtaattaaaaccgctctccgtgagaaaaaacccgtatatttagaaatcgcttgcaatatcgcttctatgccttgtgcagctcctggacctgctagtgctttatttaacgatgaagcatctgatgaggctagtttaaatgccgctgttgaagaaactttgaaatttattgctaatcgtgataaagtagctgttttagttggttctaaactccgtgccgctggtgcagaagaagcggctgtaaaattcgcagatgccttaggaggtgctgttgccacaatggcagccgctaaaagttttttccccgaagaaaatcctcattacattggtacttcttggggtgaggtatcttaccctggtgtagaaaaaaccatgaaggaagctgatgcagtaattgcattagctcctgttttcaatgattactctaccactggttggactgatattccagaccccaaaaaattagttttagcagaacctcgctctgtagttgtgaatggtgttagatttcccagtgtacatctcaaagattatttaactcgtttagctcaaaaagtgagtaaaaagactggcgcactcgatttctttaaatctttaaatgctggtgaattaaagaaagcagctcctgctgatcccagtgctcctttagtgaatgccgaaatcgcaagacaagttgaagccttgttaactcctaacactaccgttattgccgagactggtgatagttggttcaatgctcaacgcatgaaattacccaatggtgctcgtgttgagtatgaaatgcaatggggtcacattggatggtctgttcctgctgcatttggatatgcagttggagcacctgagcgtagaaacattttaatggtaggtgatggttctttccaactcactgctcaagaagttgcacaaatggtacgtttaaaattgcctgttattatctttctcattaacaactatggttacaccattgaagttatgattcatgatggtccttataataacattaagaattgggattacgcaggtttaatggaggtatttaacggtaatggtggatacgacagtggagcaggtaaaggattaaaagctaaaacaggaggtgagttagctgaagcaattaaagtagctttagccaatacagatggtcctaccttaatcgaatgtttcattggacgtgaagattgtactgaagagttagttaaatggggaaagcgtgttgccgctgcaaattctcgtaaacctgtaaacaaactcttgtagttaggatccagcaaggtttcatcccgaccccctcagggtcgggatttttttattgtgagctcaactttagatattcgtagttggcaatgtcgtaaatgcggaacaatacatggaaaacatatagatttgtaatgagaaaaagtgtaaacaaatattaagaaaaagatcagaaaaatttaacaacacgtaataaaaaaatgcgtcactacgggttataaatttacatgaaaggttaaaacacttttctgagacgattttgataaaaaagttgtcaaaaaattaagtttctttacaaatgcttaacaaaaacttggttttaagcacaaaataagagagactaatttgcagaagttttacaaggaaatcttgaagaaaaagatctaagtaaaacgactctgtttaaccaaaatttaacaaatttaacaaaacaaactaaatctattaggagattaactacatatgagtgaaactaaatttaaagcctatgccgtaatgaatcctggtgaaaaattacaaccctgggaatatgaacctgctcctttacaggtagatgaaattgaagtaagagttactcacaatggtttatgtcacactgacttacacatgagagataatgactggaatgttagtgagttccccttagtagcaggtcatgaagttgttggtgaagtaaccgctgttggtgaaaaagtaaccagtcgtaaaaaaggtgatagagttggtgtaggttggattcgtaattcttgtcgcgcttgtgaccattgtttacaaggagaagagaacatttgtagagagggttatactggtttaattgttggtcatcacggtggatttgctgatcgtgtacgtgtacctgctgacttcacttataaaattcctgatgctttagatagtgcatctgctgctcctttattatgtgccggtattaccgtttacactcctttaagaacctacattaaacatcccggtatgaaagtaggtgttatgggtattggaggattaggacatttagctattaaatttgctcgtgcaatgggagcagaagttactgcctttagtaccagtcctaataaagaagcccaagccaaagaatttggtgctcatcatttccaacaatggggtactgctgaagaaatgaaagctgttgccggtaattttgatttagttttatctaccatctctgctgaaactgactgggatgctgccttctctttattagcaaataacggtgttttatgtttcgtaggtattcccgttagttctttaaatgttcctttaattcctttaattttcggacaaaaatctgttgtaggttctgtagttggaggaagaagattcatggcagaaatgttagagttcgccgctgtaaatcagattaaacctatgatcgaaactatgcccttatctcaagtaaatgaagctatggataaagttgccgccaataaagccagatatagaattgtattattatctgaataactagatctacttctaaactgaaacaaatttgagggtaggcttcattgtctgcccttatttttttatttaggaaaagtgaacagactaaagagtgttggctctattgctttgagtatgtaaattaggcgttgctgaattaaggtatgatttttgacccctgcaggatcatcttgctgaaaaactcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgccctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttgaatatttttcgtcagatacgcaaaccttacaaacataattaacaactgaaactattgatatgtctaggttttagctctatcacaggttggatctg

SEQ ID NO: 83 - DNA, 13090 bp, Cyanobacterium sp. ABICyano1
tcgacaattaataacttcttcctgtacgggcgaatggccatttgctcctaactaactccgtactgctttgcggaacgagcgtagcgaactctccgaattactaagccttcatccctgatagatgcaaaaaacgaattaaaattatgtgtaaaaagaaaatgtgtctttatttagtagtcaaagttacaaaatattaagaatcaaattaataatgtattgggcagttaagtatataagtctttaaatatttatttgtattcaatatattaaccgaggacaaattatgaattcttacactgttggaacctatttagcagaacgtttagttcaaattggtctcaaacaccattttgcagtagctggtgattataatttagttttattggataacttattgttaaataagaatatggaacaagtgtattgttgtaatgaattaaactgtggtttttctgctgagggatatgctcgtgcaaaaggtgctgccgcagcagttgttacttattctgttggagcattaagtgcttttgacgctattggaggtgcttatgcagaaaatttacctgtaatcttaatctctggtgcacccaataacaacgatcacgctgctggtcatgtattgcatcatgctttaggtaaaaccgattatcattaccaattagaaatggcaaaaaatattaccgctgccgcagaagctatttatactcccgaagaagcacctgctaagatcgatcacgtaattaaaaccgctctccgtgagaaaaaacccgtatatttagaaatcgcttgcaatatcgcttctatgccttgtgcagctcctggacctgctagtgctttatttaacgatgaagcatctgatgaggctagtttaaatgccgctgttgaagaaactttgaaatttattgctaatcgtgataaagtagctgttttagttggttctaaactccgtgccgctggtgcagaagaagcggctgtaaaattcgcagatgccttaggaggtgctgttgccacaatggcagccgctaaaagttttttccccgaagaaaatcctcattacattggtacttcttggggtgaggtatcttaccctggtgtagaaaaaaccatgaaggaagctgatgcagtaattgcattagctcctgttttcaatgattactctaccactggttggactgatattccagaccccaaaaaattagttttagcagaacctcgctctgtagttgtgaatggtgttagatttcccagtgtacatctcaaagattatttaactcgtttagctcaaaaagtgagtaaaaagactggcgcactcgatttctttaaatctttaaatgctggtgaattaaagaaagcagctcctgctgatcccagtgctcctttagtgaatgccgaaatcgcaagacaagttgaagccttgttaactcctaacactaccgttattgccgagactggtgatagttggttcaatgctcaacgcatgaaattacccaatggtgctcgtgttgagtatgaaatgcaatggggtcacattggatggtctgttcctgctgcatttggatatgcagttggagcacctgagcgtagaaacattttaatggtaggtgatggttctttccaactcactgctcaagaagttgcacaaatggtacgtttaaaattgcctgttattatctttctcattaacaactatggttacaccattgaagttatgattcatgatggtccttataataacattaagaattgggattacgcaggtttaatggaggtatttaacggtaatggtggatacgacagtggagcaggtaaaggattaaaagctaaaacaggaggtgagttagctgaagcaattaaagtagctttagccaatacagatggtcctaccttaatcgaatgtttcattggacgtgaagattgtactgaagagttagttaaatggggaaagcgtgttgccgctgcaaattctcgtaaacctgtaaacaaactcttgtagttaggatccagcaaggtttcatcccgaccccctcagggtcgggatttttttattgtgagctcaactttagatattcgtagttggcaatgtcgtaaatgcggaacaatacatggaaaacatatagatttgtaatgagaaaaagtgtaaacaaatattaagaaaaagatcagaaaaatttaacaacacgtaataaaaaaatgcgtcactacgggttataaatttacatgaaaggttaaaacacttttctgagacgattttgataaaaaagttgtcaaaaaattaagtttctttacaaatgcttaacaaaaacttggttttaagcacaaaataagagagactaatttgcagaagttttacaaggaaatcttgaagaaaaagatctaagtaaaacgactctgtttaaccaaaatttaacaaatttaacaaaacaaactaaatctattaggagattaactacatatgattaaagcctacgctgccctggaagccaacggaaaactccaaccctttgaatacgaccccggtgccctgggtgctaatgaggtggagattgaggtgcagtattgtggggtgtgccacagtgatttgtccatgattaataacgaatggggcatttccaattaccccctagtgccgggtcatgaggtggtgggtactgtggccgccatgggcgaaggggtgaaccatgttgaggtgggggatttagtggggctgggttggcattcgggctactgcatgacctgccatagttgtttatctggctaccacaacctttgtgccacggcggaatcgaccattgtgggccactacggtggctttggcgatcgggttcgggccaagggagtcagcgtggtgaaattacctaaaggcattgacctagccagtgccgggccccttttctgtggaggaattaccgttttcagtcctatggtggaactgagtttaaagcccactgcaaaagtggcagtgatcggcattgggggcttgggccatttagcggtgcaatttctccgggcctggggctgtgaagtgactgcctttacctccagtgccaggaagcaaacggaagtgttggaattgggcgctcaccacatactagattccaccaatccagaggcgatcgccagtgcggaaggcaaatttgactatattatctccactgtgaacctgaagcttgactggaacttatacatcagcaccctggcgccccagggacatttccactttgttggggtggtgttggagcctttggatctaaatctttttccccttttgatgggacaacgctccgtttctgcctccccagtgggtagtcccgccaccattgccaccatgttggactttgctgtgcgccatgacattaaacccgtggtggaacaatttagctttgatcagatcaacgaggcgatcgcccatctagaaagcggcaaagcccattatcgggtagtgctcagccatagtaaaaattagctctgcaaaggttgcttctagatctacttctaaactgaaacaaatttgagggtaggcttcattgtctgcccttatttttttatttaggaaaagtgaacagactaaagagtgttggctctattgctttgagtatgtaaattaggcgttgctgaattaaggtatgatttttgacccctgcaggatcatcttgctgaaaaactcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgccctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttgaatatttttcgtcagatacgcaaaccttacaaacataattaacaactgaaactattgatatgtctaggttttagctctatcacaggttggatctg

SEQ ID NO: 84 - DNA, 13070 bp, Cyanobacterium sp. ABICyano1
tcgacaattaataacttcttcctgtacgggcgaatggccatttgctcctaactaactccgtactgctttgcggaacgagcgtagcgaactctccgaattactaagccttcatccctgatagatgcaaaaaacgaattaaaattatgtgtaaaaagaaaatgtgtctttatttagtagtcaaagttacaaaatattaagaatcaaattaataatgtattgggcagttaagtatataagtctttaaatatttatttgtattcaatatattaaccgaggacaaattatgaattcttacactgttggaacctatttagcagaacgtttagttcaaattggtctcaaacaccattttgcagtagctggtgattataatttagttttattggataacttattgttaaataagaatatggaacaagtgtattgttgtaatgaattaaactgtggtttttctgctgagggatatgctcgtgcaaaaggtgctgccgcagcagttgttacttattctgttggagcattaagtgcttttgacgctattggaggtgcttatgcagaaaatttacctgtaatcttaatctctggtgcacccaataacaacgatcacgctgctggtcatgtattgcatcatgctttaggtaaaaccgattatcattaccaattagaaatggcaaaaaatattaccgctgccgcagaagctatttatactcccgaagaagcacctgctaagatcgatcacgtaattaaaaccgctctccgtgagaaaaaacccgtatatttagaaatcgcttgcaatatcgcttctatgccttgtgcagctcctggacctgctagtgctttatttaacgatgaagcatctgatgaggctagtttaaatgccgctgttgaagaaactttgaaatttattgctaatcgtgataaagtagctgttttagttggttctaaactccgtgccgctggtgcagaagaagcggctgtaaaattcgcagatgccttaggaggtgctgttgccacaatggcagccgctaaaagttttttccccgaagaaaatcctcattacattggtacttcttggggtgaggtatcttaccctggtgtagaaaaaaccatgaaggaagctgatgcagtaattgcattagctcctgttttcaatgattactctaccactggttggactgatattccagaccccaaaaaattagttttagcagaacctcgctctgtagttgtgaatggtgttagatttcccagtgtacatctcaaagattatttaactcgtttagctcaaaaagtgagtaaaaagactggcgcactcgatttctttaaatctttaaatgctggtgaattaaagaaagcagctcctgctgatcccagtgctcctttagtgaatgccgaaatcgcaagacaagttgaagccttgttaactcctaacactaccgttattgccgagactggtgatagttggttcaatgctcaacgcatgaaattacccaatggtgctcgtgttgagtatgaaatgcaatggggtcacattggatggtctgttcctgctgcatttggatatgcagttggagcacctgagcgtagaaacattttaatggtaggtgatggttctttccaactcactgctcaagaagttgcacaaatggtacgtttaaaattgcctgttattatctttctcattaacaactatggttacaccattgaagttatgattcatgatggtccttataataacattaagaattgggattacgcaggtttaatggaggtatttaacggtaatggtggatacgacagtggagcaggtaaaggattaaaagctaaaacaggaggtgagttagctgaagcaattaaagtagctttagccaatacagatggtcctaccttaatcgaatgtttcattggacgtgaagattgtactgaagagttagttaaatggggaaagcgtgttgccgctgcaaattctcgtaaacctgtaaacaaactcttgtagttaggatccagcaaggtttcatcccgaccccctcagggtcgggatttttttattgtgagctcaactttagatattcgtagttggcaatgtcgtaaatgcggaacaatacatggaaaacatatagatttgtaatgagaaaaagtgtaaacaaatattaagaaaaagatcagaaaaatttaacaacacgtaataaaaaaatgcgtcactacgggttataaatttacatgaaaggttaaaacacttttctgagacgattttgataaaaaagttgtcaaaaaattaagtttctttacaaatgcttaacaaaaacttggttttaagcacaaaataagagagactaatttgcagaagttttacaaggaaatcttgaagaaaaagatctaagtaaaacgactctgtttaaccaaaatttaacaaatttaacaaaacaaactaaatctattaggagattaactacatatgcctatgatcaaagccttcgcagttcatgagtctgatggagatttacagccttttgaatatgatcctggtgcattattatctgatcaagttgagatcgaagttaaatattgtggaatttgtcattctgatttatctatgatctctaatgaatggggtatgacccaataccctttagtacctggacatgaggtagtaggtgcaatcgccaaagtaggtgaaaatgttaaaaatttatctgttggtcaaattgtaggattaggttggcacgcaggttattgtaacgaatgtcctcaatgtactactggtgatcaaaatttatgtgctactgctcaaggaactattgtaggacatcatggaggtttcgctgaaaaagttcgcgctgctgcaaattctgtagttcccatccctgaaggaatcgatttagaagctgctggacctttattttgtggaggtatcaccgtttttaatcctttagtacaatatggaatccaacccactgcaaaagttgctgtaattggaattggaggtttaggtcacatggctgttcaattcttaaacgcttggggttgtgaagttaccgcttttaccagttctgaagcaaaaatcactgaggctttagaattaggtgctcatcacactttaaacagtcgtgaccctgaagccatcgcagccgctgctggacagtttgatttaatcatttctaccgttaacgttaaattagattggaatgcctatttaagtactttaaaacctcacggtcgtttacacttcgtaggtgctactttagatcccttagacattaacgtttttgctttaatcatgcagcaacgttctatctctggtagtcctgttggatctcctgcaaccatcgcaaaaatgttagaatttgcaaaattacataaaattcaacctaaaattgaaacctttaaatttgaagatgttaaccaggctattgcacgtttaaaaagtggtgaagcccactatcgtattgtattatgtagataactagatctacttctaaactgaaacaaatttgagggtaggcttcattgtctgcccttatttttttatttaggaaaagtgaacagactaaagagtgttggctctattgctttgagtatgtaaattaggcgttgctgaattaaggtatgatttttgacccctgcaggatcatcttgctgaaaaactcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgccctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttgaatatttttcgtcagatacgcaaaccttacaaacataattaacaactgaaactattgatatgtctaggttttagctctatcacaggttggatctg

SEQ ID NO: 85 - DNA, 13063 bp, Cyanobacterium sp. ABICyano1
tcgacaattaataacttcttcctgtacgggcgaatggccatttgctcctaactaactccgtactgctttgcggaacgagcgtagcgaactctccgaattactaagccttcatccctgatagatgcaaaaaacgaattaaaattatgtgtaaaaagaaaatgtgtctttatttagtagtcaaagttacaaaatattaagaatcaaattaataatgtattgggcagttaagtatataagtctttaaatatttatttgtattcaatatattaaccgaggacaaattatgaattcttataccgtgggtacttatttagccgaacgcttagtgcaaattggtttaaaacatcattttgccgtggctggggactataatttagtgttattggataacttattattaaataaaaacatggaacaagtgtattgttgtaatgaattaaattgtggtttttctgctgaaggttatgctagagctaaaggtgcagctgctgctgttgttacttattctgtgggtgctttatctgcttttgatgctattggtggtgcttatgccgaaaatttacccgtgattttaatttctggtgcccctaataataatgatcatgccgctggacatgttttacatcatgccttaggtaaaaccgattatcattatcaattagaaatggccaaaaatattactgctgctgccgaagctatttatactcctgaagaagcccctgccaaaattgatcatgtgattaaaaccgccttacgcgaaaaaaaacccgtgtatttagaaattgcctgtaatattgcttctatgccttgtgctgctcctgggcctgcttctgctttatttaatgatgaagcctctgatgaagctagtttaaatgctgccgtggaagaaaccttaaaatttattgccaatcgcgataaagttgccgtgttagttggttctaaattaagagctgctggtgctgaagaagctgctgttaaatttgctgatgctttaggtggtgcagttgctactatggctgctgccaaatctttttttcccgaagaaaatccccattatattggaactagttggggagaagtttcttatcctggtgtggaaaaaactatgaaagaagccgacgctgttattgctttagcccctgtgtttaatgattattctaccactggttggactgatattcccgatcccaaaaaattagttttagccgaacctcgttctgttgttgttaatggtgttcgctttccctctgtgcatttaaaagattatttaacccgcttagcccaaaaagtttctaaaaaaactggtgccttagatttttttaaatctttaaatgcgggtgaattaaaaaaagctgctcctgctgatccttctgctcctttagttaatgctgaaattgcccgtcaagttgaagccttattaacccctaatactaccgttattgccgaaactggtgattcttggtttaatgcccaacgcatgaaattacctaatggtgcccgtgttgaatatgaaatgcaatggggtcatattggttggtctgtacctgctgcttttggttatgctgttggtgctcctgaacgtcgtaatattttaatggtgggtgatggttcttttcaattaactgcccaagaagttgcccaaatggttcgcttaaaattacccgttattatttttttaataaataattatggttataccattgaagtgatgattcatgatgggccatataataatattaaaaattgggattatgcgggtttaatggaagtgtttaatggtaatggtggttatgattctggtgctggtaaaggtttaaaagccaaaactggtggtgaattagctgaagctattaaagttgccttagccaatactgatgggccaaccttaattgaatgttttattggtcgcgaagattgtaccgaagaattagttaaatggggtaaacgtgttgctgctgctaattctcgcaaacccgtgaataaattattgtaaggatccagcaagtttcatcccgaccccctcagggtcgggatttttttattgtgagctcaactttagatattcgtagttggcaatgtcgtaaatgcggaacaatacatggaaaacatatagatttgtaatgagaaaaagtgtaaacaaatattaagaaaaagatcagaaaaatttaacaacacgtaataaaaaaatgcgtcactacgggttataaatttacatgaaaggttaaaacacttttctgagacgattttgataaaaaagttgtcaaaaaattaagtttctttacaaatgcttaacaaaaacttggttttaagcacaaaataagagagactaatttgcagaagttttacaaggaaatcttgaagaaaaagatctaagtaaaacgactctgtttaaccaaaatttaacaaatttaacaaaacaaactaaatctattaggagattaactacatatgatccgtgcttatgcagctcaggagaaaggaggtaaattagaaccctttgattatgaccctggtattttagcagacgaagacgttgagattgctgttgagtactgtggaatttgtcattccgatttatctatgctcgataatgactggggtttaactacttaccctttcgttcccggtcacgaggttgtaggaaccattgctgcattaggagccaaagtaaaagaactcaaattgggtcagcgtgtaggattaggatggttcagtcgttcttgttctacctgtgagacttgtatgtctggtgatcaaaatttatgtgcaaccgctgaaggtactattgtaggaagacatggtggatttgctgagcgtgttcgtgctcaccattcttggttagtacctttacccgatcaattagacgcagctaaagccggtcctttattttgtggtggtatcactgtatttaatcctatcgttcagttcaacatcaaacctaccgcacgtgtaggtgttatcggaatcggaggtttaggtcacattgctctcaaatttttaaaagcatggggttgtgaggtaactgcctttagttcttctcctgacaaagaaaccgaagctaaagagttaggtgcaacccattttattaactctcgtgatcctgaagcattacaaagtgttcagaactatttcgactttattattagtactgtaaatgtaaacttagattggggattatacattgcttgtttacgtcctaaaggaagattacacattgtaggtgcagtattagagcctatggctacttatgcattccctttaatcatgggacagaaatctattagtggatctcccttaggatctcctagtactgtttctaaaatgatcgagtttgcttcccgtcatggtatcgagcccgttaccgaaacttaccccatttctcgtgttaacgaagcaatggagaaattaagaactggtcagcccaaatacagattggttctccaaattaaataactagatctacttctaaactgaaacaaatttgagggtaggcttcattgtctgcccttatttttttatttaggaaaagtgaacagactaaagagtgttggctctattgctttgagtatgtaaattaggcgttgctgaattaaggtatgatttttgacccctgcaggatcatcttgctgaaaaactcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgccctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttgaatatttttcgtcagatacgcaaaccttacaaacataattaacaactgaaactattgatatgtctaggttttagctctatcacaggttggatctg

SEQ ID NO: 86 - DNA, 13099 bp, Cyanobacterium sp. ABICyano1
tcgacaattaataacttcttcctgtacgggcgaatggccatttgctcctaactaactccgtactgctttgcggaacgagcgtagcgaactctccgaattactaagccttcatccctgatagatgcaaaaaacgaattaaaattatgtgtaaaaagaaaatgtgtctttatttagtagtcaaagttacaaaatattaagaatcaaattaataatgtattgggcagttaagtatataagtctttaaatatttatttgtattcaatatattaaccgaggacaaattatgaattcttataccgtgggtacttatttagccgaacgcttagtgcaaattggtttaaaacatcattttgccgtggctggggactataatttagtgttattggataacttattattaaataaaaacatggaacaagtgtattgttgtaatgaattaaattgtggtttttctgctgaaggttatgctagagctaaaggtgcagctgctgctgttgttacttattctgtgggtgctttatctgcttttgatgctattggtggtgcttatgccgaaaatttacccgtgattttaatttctggtgcccctaataataatgatcatgccgctggacatgttttacatcatgccttaggtaaaaccgattatcattatcaattagaaatggccaaaaatattactgctgctgccgaagctatttatactcctgaagaagcccctgccaaaattgatcatgtgattaaaaccgccttacgcgaaaaaaaacccgtgtatttagaaattgcctgtaatattgcttctatgccttgtgctgctcctgggcctgcttctgctttatttaatgatgaagcctctgatgaagctagtttaaatgctgccgtggaagaaaccttaaaatttattgccaatcgcgataaagttgccgtgttagttggttctaaattaagagctgctggtgctgaagaagctgctgttaaatttgctgatgctttaggtggtgcagttgctactatggctgctgccaaatctttttttcccgaagaaaatccccattatattggaactagttggggagaagtttcttatcctggtgtggaaaaaactatgaaagaagccgacgctgttattgctttagcccctgtgtttaatgattattctaccactggttggactgatattcccgatcccaaaaaattagttttagccgaacctcgttctgttgttgttaatggtgttcgctttccctctgtgcatttaaaagattatttaacccgcttagcccaaaaagtttctaaaaaaactggtgccttagatttttttaaatctttaaatgcgggtgaattaaaaaaagctgctcctgctgatccttctgctcctttagttaatgctgaaattgcccgtcaagttgaagccttattaacccctaatactaccgttattgccgaaactggtgattcttggtttaatgcccaacgcatgaaattacctaatggtgcccgtgttgaatatgaaatgcaatggggtcatattggttggtctgtacctgctgcttttggttatgctgttggtgctcctgaacgtcgtaatattttaatggtgggtgatggttcttttcaattaactgcccaagaagttgcccaaatggttcgcttaaaattacccgttattatttttttaataaataattatggttataccattgaagtgatgattcatgatgggccatataataatattaaaaattgggattatgcgggtttaatggaagtgtttaatggtaatggtggttatgattctggtgctggtaaaggtttaaaagccaaaactggtggtgaattagctgaagctattaaagttgccttagccaatactgatgggccaaccttaattgaatgttttattggtcgcgaagattgtaccgaagaattagttaaatggggtaaacgtgttgctgctgctaattctcgcaaacccgtgaataaattattgtaaggatccagcaagtttcatcccgaccccctcagggtcgggatttttttattgtgagctcaactttagatattcgtagttggcaatgtcgtaaatgcggaacaatacatggaaaacatatagatttgtaatgagaaaaagtgtaaacaaatattaagaaaaagatcagaaaaatttaacaacacgtaataaaaaaatgcgtcactacgggttataaatttacatgaaaggttaaaacacttttctgagacgattttgataaaaaagttgtcaaaaaattaagtttctttacaaatgcttaacaaaaacttggttttaagcacaaaataagagagactaatttgcagaagttttacaaggaaatcttgaagaaaaagatctaagtaaaacgactctgtttaaccaaaatttaacaaatttaacaaaacaaactaaatctattaggagattaactacatatggttatccaggcttacgctgctcatgaaaaaggtggagagttaaaaccttttgagtatgatcccggtgtattaggtgaagaagaagtagaaatcaatgtagaatactgtggtatttgtcacagtgacttatctatgttagataacgagtggcagatgagtgaatatcccttagttcctggacacgaggttgtaggtactgttggtgctgtaggtaacggtgtagaaaccttatctgtaggtcagaaagtaggtttaggttggtttagtcgtagttgttttaactgtgaatggtgtattggtggagatcagaatttatgtcgtaccgctgaaggaactatcgttggaagacatggaggttttgctaacaaagttcgtgctcatcatcgttgggtaacccccttacccagtgaaatcaatttagagactgctggtcccttattctgtggtggtatcactgtttttaatcccatcattcaatgtggagtaaaacctaccgagcgtgttggtgttattggtatcggtggattaggtcatttagcaatccaatttttacatgcttggggatgtgaggtaactgctttttcttcttctcccgaaaaagaagcagaagccagacaattaggagccgatcactttatcaattctcgtgaatctaatgccttagaaagtgtagaaaattctttcgattttatcattagtaccgttaatgttgatttagactggaacggttatgttaatgctttacgtcccaaaggaagattacattttgtaggtgtaatccctaatcctttatctatccaaattttccctttattagtaggtcaaaaatctattagtagttctcccttaggatctcccattactattgcccaaatgttagactttgcaactcgtcatcatattgaacctatgattgaattattttctttagaaaaagttaacgaagccttaactaaattaaaacaaggtcaacctcgttatcgtttagtattaaaagtttaactagatcttccggatggctcgagtttttcagcaagataagatctacttctaaactgaaacaaatttgagggtaggcttcattgtctgcccttatttttttatttaggaaaagtgaacagactaaagagtgttggctctattgctttgagtatgtaaattaggcgttgctgaattaaggtatgatttttgacccctgcaggatcatcttgctgaaaaactcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgccctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttgaatatttttcgtcagatacgcaaaccttacaaacataattaacaactgaaactattgatatgtctaggttttagctctatcacaggttggatctg

SEQ ID NO: 87 - DNA, 12983 bp, Cyanobacterium sp. ABICyano1
tcgacaattaataacttcttcctgtacgggcgaatggccatttgctcctaactaactccgtactgctttgcggaacgagcgtagcgaactctccgaattactaagccttcatccctgatagatgcaaaaaacgaattaaaattatgtgtaaaaagaaaatgtgtctttatttagtagtcaaagttacaaaatattaagaatcaaattaataatgtattgggcagttaagtatataagtctttaaatatttatttgtattcaatatattaaccgaggacaaattatgaattcttataccgtgggtacttatttagccgaacgcttagtgcaaattggtttaaaacatcattttgccgtggctggggactataatttagtgttattggataacttattattaaataaaaacatggaacaagtgtattgttgtaatgaattaaattgtggtttttctgctgaaggttatgctagagctaaaggtgcagctgctgctgttgttacttattctgtgggtgctttatctgcttttgatgctattggtggtgcttatgccgaaaatttacccgtgattttaatttctggtgcccctaataataatgatcatgccgctggacatgttttacatcatgccttaggtaaaaccgattatcattatcaattagaaatggccaaaaatattactgctgctgccgaagctatttatactcctgaagaagcccctgccaaaattgatcatgtgattaaaaccgccttacgcgaaaaaaaacccgtgtatttagaaattgcctgtaatattgcttctatgccttgtgctgctcctgggcctgcttctgctttatttaatgatgaagcctctgatgaagctagtttaaatgctgccgtggaagaaaccttaaaatttattgccaatcgcgataaagttgccgtgttagttggttctaaattaagagctgctggtgctgaagaagctgctgttaaatttgctgatgctttaggtggtgcagttgctactatggctgctgccaaatctttttttcccgaagaaaatccccattatattggaactagttggggagaagtttcttatcctggtgtggaaaaaactatgaaagaagccgacgctgttattgctttagcccctgtgtttaatgattattctaccactggttggactgatattcccgatcccaaaaaattagttttagccgaacctcgttctgttgttgttaatggtgttcgctttccctctgtgcatttaaaagattatttaacccgcttagcccaaaaagtttctaaaaaaactggtgccttagatttttttaaatctttaaatgcgggtgaattaaaaaaagctgctcctgctgatccttctgctcctttagttaatgctgaaattgcccgtcaagttgaagccttattaacccctaatactaccgttattgccgaaactggtgattcttggtttaatgcccaacgcatgaaattacctaatggtgcccgtgttgaatatgaaatgcaatggggtcatattggttggtctgtacctgctgcttttggttatgctgttggtgctcctgaacgtcgtaatattttaatggtgggtgatggttcttttcaattaactgcccaagaagttgcccaaatggttcgcttaaaattacccgttattatttttttaataaataattatggttataccattgaagtgatgattcatgatgggccatataataatattaaaaattgggattatgcgggtttaatggaagtgtttaatggtaatggtggttatgattctggtgctggtaaaggtttaaaagccaaaactggtggtgaattagctgaagctattaaagttgccttagccaatactgatgggccaaccttaattgaatgttttattggtcgcgaagattgtaccgaagaattagttaaatggggtaaacgtgttgctgctgctaattctcgcaaacccgtgaataaattattgtaaggatccagcaaggtttcatcccgaccccctcagggtcgggatttttttattgtgagctcaactttagatattcgtagttggcaatgtcgtaaatgcggaacaatacatggaaaacatatagatttgtaatgagaaaaagtgtaaacaaatattaagaaaaagatcagaaaaatttaacaacacgtaataaaaaaatgcgtcactacgggttataaatttacatgaaaggttaaaacacttttctgagacgattttgataaaaaagttgtcaaaaaattaagtttctttacaaatgcttaacaaaaacttggttttaagcacaaaataagagagactaatttgcagaagttttacaaggaaatcttgaagaaaaagatctaagtaaaacgactctgtttaaccaaaatttaacaaatttaacaaaacaaactaaatctattaggagattaactacatatgattagagcctatgctgcccaagaaaaagggggaaaactagagccttttgactacgatccgggcatattagcggatgaagatgtagaaatcgcggtggaatattgcggcatctgccacagtgacctaagtatgctcgataacgattggggactgaccacctatccctttgtccctggccatgaagtggtcggcacgatcgccgctcttggtgctaaagtcaaagagttaaaattagggcaaagagtcggtctcggttggttttcccgttcctgttccacctgtgaaacctgtatgtcaggggatcaaaacctttgtgctactgccgaaggaactatcgtcggtcgccatggcggttttgccgaaagagtccgggcccatcatagttggttagttcccttgccggaccagttagatgctgccaaagctggcccgcttttctgtggtggcattaccgtctttaatccgattgtccaatttaatattaaacccacggcccgagttggtgtcattggtattggtggattgggccatatagccttaaaattcctcaaagcttggggctgcgaagtaaccgctttttccagtagtcccgacaaagaaacggaagcaaaagaactaggagcgactcattttatcaattccagagaccccgaagctttgcaatcggtacaaaattactttgattttatcatctctaccgttaacgttaatctcgattggggtctttatatcgcctgtttacgacccaaaggtcgcctgcatattgttggcgctgttcttgaacccatggctacctacgcttttcccttgattatgggtcaaaaatcgatttccggcagtcctttgggtagtcccagtaccgtcagtaaaatgattgaatttgcctctcgccatggcattgaaccagtcacagaaacctatcctatctcccgggtgaatgaagccatggaaaaattgcgaaccggacaacctaaatatcgcctcgtcttgcaaataaaataactagatctcctgcagagaatataaaaagccagattattaatccggcttttttattatttaaatactgtgcacgatcctgcaggatcatcttgctgaaaaactcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgccctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttgaatatttttcgtcagatacgcaaaccttacaaacataattaacaactgaaactattgatatgtctaggttttagctctatcacaggttggatctg

SEQ ID NO: 88 - DNA, 6388 bp, Cyanobacterium sp. ABICyano1
tcgacttctgcagcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatggctcatattcaacgtgaaactagttgttctcgtcctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacggcggccgcgaataggaaatctcagttcagagttcggggtgttcactgcactagtcatgaacgggatttttaattcttaattcttaattcttaattatcaattatttaacgtcagttcgggtttgagaatgaaaaaaccctagggataaaggggggtttgcccctagccctttttataaaaaaagaattaaaagctaatcagaaatgaaaaaaataggcagtttaggagagaaaataattgcccagtggttaataaataaaggttattctgttatagaatcaaattggcattgtcgttggggtgaaattgaccttatagtaataaataaaagtttaaaagagattatatttgttgaagttaaaactcgcagtataaaaaattgggatgataatgggctatactctattaataacaaaaaacaagaaaaactctggttaacagctagtttatttttagaaaaaaatcaaatatttactgattggaactgtcgttttgatattgctttattaacttacaaaaaattaactaactttgggacagtattttctgttaacgataattgtttaagaccaaagtttaactatgaaggctatcaatttgaaattgttgattatttggaaaatgctttttaatctgatcttctgcacgtcaaatagtattctacaagacaattcagaatttagaatatattttttggcgttgcttaattatggtatgaaatttactgaaattatgccaaaaattgagacatcaaaatattatcattactgcaagaatgcccatttccccaaccccacctaaatgagaaatcatatacaaaactagtaaagcctatttttttgttacgagattatcccctaactttccattgaggaatcttcaattgtttatcaatgctttttctgctataattgcactcatggtaaggattgaaaacctaaattttaaggtcaattatcttaacttaatcgatagttgtctaagtataactaattgttatagttcatgaagatcaaaatatattgcattttccgcagtattgacagaaacagaagttagtaataaagcaacactatgggtatcagagaaatagttgataattcaagcgatttagaatttagaatcgttagattgatgctaatgccaatagaaatagaattaacttttattaaagaaatagctactattcctttagtctcagctcaaaattagtggactctctactaaattctgtttaggattgccttgttagttaataaattcgctattctcctgattatttttgcgaggagaaaagtcaagtatttacttttttaaaattatgtataaagatataattagtcaccgattaaaactttcattttaagatgatatgagtctaattgtgaacatggaaaagtcgggttttttaaattttacaacttttaggaaactgaaaatataaagtatgaaaaactttatttattcctgaagtcaataggacaaagttcgatgggcaaagggcaaaatgattttgcaagtaccttgacaaaccaaaaattactcgtcttaaaagactgagttttaaacccattgttctttgataaatgataaagaaacgataggataagttaataaaaaatgattttctgggaatcacaagaatttatgaagagatataaaaaaactttcctaagttaagaaaattaagaaaaactaatccatgagactacataaaaacaaggcaaaattttaagattgaactaacattaataattgatttctttaccataattactttgtcttttcataactaattgtgattaaaacagttgaaagtcagactctttttattagctttatatcgttaactaaacattatctgattgtgacaaatttaagcaaaatattttcaaaattatcaacacagaagcgaaaattttgtgaggatatcaatctagaatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctaatgcatattttaccctcgacaaatccaagaccatgcaacatttagggtagaattatttttatactcgtaatgtgattgatgtttataacccatgatttttcccgatttttctgcattttctaaccttgttcatcagggaaattttattcctgtttatcgagaattggtagcggatttagaaacccctgtttctgcttggtataaagtttgtgcagaccagccctatagtttcttgttagagtcagtagaaggtggggaaaatttaggaagatatagctttttaggttgtgatcctgtttggatactagaagcaaggggaaatcagaccaaacaagttcatcgtgatggtaaaatcgaaactttttcaggaaatccctttaacatcctctctcaatgtttagaaactattaaacctgttaaattaccagagttgccccccggtattggcggactatttggttattggggttatgagttaatttcttggattgaaccacgagtcaacgtttatcctgcctctgcggaaagtttacccgatggtatttggatgcaggtagataatttattgatttttgatcaagtaaaaagaaaaatatgggcgatcgcatatgcagatttaagacaggagcatttaagcctagaagaaatctacaatcaggcttgtgacaaaatttctaaattagttttaaaactacaattacctttaccagtatccgcaaaaccccttgaatttaaccccccgccaaaaactcaaaaaaatcatcgcattcaatacaaaagcaacaccagcaaagaggcattttgtgccaatgtggaaaaagctaaagaatacattaaagcaggagatatttttcaagtagtcatttctcagaaattacaatctcattatcaaggtcatccttttgagttgtatcgctccttacgtttgattaacccttccccttatatggcttactataactttcatggatggcagttaatcggctcttctcccgaagtaatggttaaagcagaaaaaactaatgatggtaaaaccaaagccgtagtccgtcccattgcaggaacacgtccaaggggcagaaactatcaagaagaccaatttttagcccaagacttactcaatgatcccaaagaaagggcagaacacgtcatgttagtagatttgggcagaaatgacttaggcagggtctgtgtaaaaggaagcgtggaagtcgatgaattgatggttattgaacgttattcccacgtaatgcacatagtcagtaacgttgtgggagagttagcaggggattactgtgcatgggatttactaaaggcggctttccccgcaggtacggtaagtggagctcctaaaattcgagcaatggaaattattaatgaacttgaacccgaaaggaggggaccttattctggggtttatggttactatgattttgaaggacagttaaatactgctatcacaattagaacgatggttgtggaaaccctttctgggacggaaaatcacttggtatccgttcaagctggagcaggcttagtcgctgactcagatccagacaaggagtatcaagaaactttgaataaagctagaggtttgctagaggcgattagtagcttaagctaagtgaaaattcgtaataaaaaagagcaaatttttgtgactttaaacctgacacctgaaatttatttttgaactccgaacccaaataatgattcaggttgcttaaactcagagaatcattaataattgattcttgttaactcaattgtcatttttaacatgggtgttgaactccgaagctatgtctatctcgatcgattacaacctcaacacgcttcctatataggtacggttgctctaggatttttacctttacccggtgatgcttctttatggattgaaatatcccccggaattgaaataaatcgaattactgatgtggctttgaagtctgctgg

SEQ ID NO: 89 - DNA, 6005 bp, Cyanobacterium sp. ABICyano1
tcgacttctgcagcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatggtaagatcaagtaacgacgtaacccagcaaggtagtagacctaaaacaaagttgggaggctcaagtatgggtatcattcgcacttgtaggttagggcccgatcaagtgaaatctatgcgagctgctttagatctttttggtagagaatttggtgatgttgcaacttatagtcaacatcaaccagattccgactatttgggaaatcttttacgttctaaaacattcattgcattagcagcatttgatcaggaagctgttgtcggtgcattagccgcttatgttttacccaagtttgaacaacctcgttctgagatctatatctacgatttagcggtatctggcgagcatcgtcgccaagggatagcaacagcgttaatcaatttgttaaagcatgaagctaatgctcttggtgcctatgtgatttacgttcaagcggactatggagatgatcctgccgtagccttgtataccaaacttggaattagagaagaagttatgcactttgatattgatccttctactgctacttaacaattcgttcaagccgagatttaaattacgtacacggcggccgcgaataggaaatctcagttcagagttcggggtgttcactgcactagtcatgaacgggatttttaattcttaattcttaattcttaattatcaattatttaacgtcagttcgggtttgagaatgaaaaaaccctagggataaaggggggtttgcccctagccctttttataaaaaaagaattaaaagctaatcagaaatgaaaaaaataggcagtttaggagagaaaataattgcccagtggttaataaataaaggttattctgttatagaatcaaattggcattgtcgttggggtgaaattgaccttatagtaataaataaaagtttaaaagagattatatttgttgaagttaaaactcgcagtataaaaaattgggatgataatgggctatactctattaataacaaaaaacaagaaaaactctggttaacagctagtttatttttagaaaaaaatcaaatatttactgattggaactgtcgttttgatattgctttattaacttacaaaaaattaactaactttgggacagtattttctgttaacgataattgtttaagaccaaagtttaactatgaaggctatcaatttgaaattgttgattatttggaaaatgctttttaatctgatcttctgcacgtcaaatagtattctacaagacaattcagaatttagaatatattttttggcgttgcttaattatggtatgaaatttactgaaattatgccaaaaattgagacatcaaaatattatcattactgcaagaatgcccatttccccaaccccacctaaatgagaaatcatatacaaaactagtaaagcctatttttttgttacgagattatcccctaactttccattgaggaatcttcaattgtttatcaatgctttttctgctataattgcactcatggtaaggattgaaaacctaaattttaaggtcaattatcttaacttaatcgatagttgtctaagtataactaattgttatagttcatgaagatcaaaatatattgcattttccgcagtattgacagaaacagaagttagtaataaagcaacactatgggtatcagagaaatagttgataattcaagcgatttagaatttagaatcgttagattgatgctaatgccaatagaaatagaattaacttttattaaagaaatagctactattcctttagtctcagctcaaaattagtggactctctactaaattctgtttaggattgccttgttagttaataaattcgctattctcctgattatttttgcgaggagaaaagtcaagtatttacttttttaaaattatgtataaagatataattagtcaccgattaaaactttcattttaagatgatatgagtctaattgtgaacatggaaaagtcgggttttttaaattttacaacttttaggaaactgaaaatataaagtatgaaaaactttatttattcctgaagtcaataggacaaagttcgatgggcaaagggcaaaatgattttgcaagtaccttgacaaaccaaaaattactcgtcttaaaagactgagttttaaacccattgttctttgataaatgataaagaaacgataggataagttaataaaaaatgattttctgggaatcacaagaatttatgaagagatataaaaaaactttcctaagttaagaaaattaagaaaaactaatccatgagactacataaaaacaaggcaaaattttaagattgaactaacattaataattgatttctttaccataattactttgtcttttcataactaattgtgattaaaacagttgaaagtcagactctttttattagctttatatcgttaactaaacattatctgattgtgacaaatttaagcaaaatattttcaaaattatcaacacagaagcgaaaattttgtgaggatatcaatctagaatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctaatgcatattttaccctcgacaaatccaagaccatgcaacatttagggtagaattatttttatactcgtaatgtgattgatgtttataacccatgatttttcccgatttttctgcattttctaaccttgttcatcagggaaattttattcctgtttatcgagaattggtagcggatttagaaacccctgtttctgcttggtataaagtttgtgcagaccagccctatagtttcttgttagagtcagtagaaggtggggaaaatttaggaagatatagctttttaggttgtgatcctgtttggatactagaagcaaggggaaatcagaccaaacaagttcatcgtgatggtaaaatcgaaactttttcaggaaatccctttaacatcctctctcaatgtttagaaactattaaacctgttaaattaccagagttgccccccggtattggcggactatttggttattggggttatgagttaatttcttggattgaaccacgagtcaacgtttatcctgcctctgcggaaagtttacccgatggtatttggatgcaggtagataatttattgatttttgatcaagtaaaaagaaaaatatgggcgatcgcatatgcagatttaagacaggagcatttaagcctagaagaaatctacaatcaggcttgtgacaaaatttctaaattagttttaaaactacaattacctttaccagtatccgcaaaaccccttgaatttaaccccccgccaaaaactcaaaaaaatcatcgcattcaatacaaaagcaacaccagcaaagaggcattttgtgccaatgtggaaaaagctaaagaatacattaaagcaggagatatttttcaagtagtcatttctcagaaattacaatctcattatcaaggtcatccttttgagttgtatcgctccttacgtttgattaacccttccccttatatggcttactataactttcatggatggcagttaatcggctcttctcccgaagtaatggttaaagcagaaaaaactaatgatggtaaaaccaaagccgtagtccgtcccattgcaggaacacgtccaaggggcagaaactatcaagaagaccaatttttagcccaagacttactcaatgatcccaaagaaagggcagaacacgtcatgttagtagatttgggcagaaatgacttaggcagggtctgtgtaaaaggaagcgtggaagtcgatgaattgatggttattgaacgttattcccacgtaatgcacatagtcagtaacgttgtgggagagttagcaggggattactgtgcatgggatttactaaaggcggctttccccgcaggtacggtaagtggagctcctaaaattcgagcaatggaaattattaatgaacttgaacccgaaaggaggggaccttattctggggtttatggttactatgattttgaaggacagttaaatactgctatcacaattagaacgatggttgtggaaaccctttctgggacggaaaatcacttggtatccgttcaagctggagcaggcttagtcgctgactcagatccagacaaggagtatcaagaaactttgaataaagctagaggtttgctagaggcgattagtagcttaagctaagtgaaaattcgtaataaaaaagagcaaatttttgtgactttaaacctgacacctgaaatttatttttgaactccgaacccaaataatgattcaggttgcttaaactcagagaatcattaataattgattcttgttaactcaattgtcatttttaacatgggtgttgaactccgaagctatgtctatctcgatcgattacaacctcaacacgcttcctatataggtacggttgctctaggatttttacctttacccggtgatgcttctttatggattgaaatatcccccggaattgaaataaatcgaattactgatgtggctttgaagtctgctgg

SEQ ID NO: 90 - DNA, 5870 bp, Cyanobacterium sp. ABICyano1
tcgacttctgcagtgagaaaaagtgtaaacaaatattaagaaaaagatcagaaaaatttaacaacacgtaataaaaaaatgcgtcactacgggttataaatttacatgaaaggttaaaacacttttctgagacgattttgataaaaaagttgtcaaaaaattaagtttctttacaaatgcttaacaaaaacttggttttaagcacaaaataagagagactaatttgcagaagttttacaaggaaatcttgaagaaaaagatctaagtaaaacgactctgtttaaccaaaatttaacaaatttaacaaaacaaactaaatctattaggagattaactaaaaccatggtaagatcaagtaacgacgtaacccagcaaggtagtagacctaaaacaaagttgggaggctcaagtatgggtatcattcgcacttgtaggttagggcccgatcaagtgaaatctatgcgagctgctttagatctttttggtagagaatttggtgatgttgcaacttatagtcaacatcaaccagattccgactatttgggaaatcttttacgttctaaaacattcattgcattagcagcatttgatcaggaagctgttgtcggtgcattagccgcttatgttttacccaagtttgaacaacctcgttctgagatctatatctacgatttagcggtatctggcgagcatcgtcgccaagggatagcaacagcgttaatcaatttgttaaagcatgaagctaatgctcttggtgcctatgtgatttacgttcaagcggactatggagatgatcctgccgtagccttgtataccaaacttggaattagagaagaagttatgcactttgatattgatccttctactgctacttaacaattcgttcaagccgagatttaaattacgtacacggcggccgcgaataggaaatctcagttcagagttcggggtgttcactgcactagtcatgaacgggatttttaattcttaattcttaattcttaattatcaattatttaacgtcagttcgggtttgagaatgaaaaaaccctagggataaaggggggtttgcccctagccctttttataaaaaaagaattaaaagctaatcagaaatgaaaaaaataggcagtttaggagagaaaataattgcccagtggttaataaataaaggttattctgttatagaatcaaattggcattgtcgttggggtgaaattgaccttatagtaataaataaaagtttaaaagagattatatttgttgaagttaaaactcgcagtataaaaaattgggatgataatgggctatactctattaataacaaaaaacaagaaaaactctggttaacagctagtttatttttagaaaaaaatcaaatatttactgattggaactgtcgttttgatattgctttattaacttacaaaaaattaactaactttgggacagtattttctgttaacgataattgtttaagaccaaagtttaactatgaaggctatcaatttgaaattgttgattatttggaaaatgctttttaatctgatcttctgcacgtcaaatagtattctacaagacaattcagaatttagaatatattttttggcgttgcttaattatggtatgaaatttactgaaattatgccaaaaattgagacatcaaaatattatcattactgcaagaatgcccatttccccaaccccacctaaatgagaaatcatatacaaaactagtaaagcctatttttttgttacgagattatcccctaactttccattgaggaatcttcaattgtttatcaatgctttttctgctataattgcactcatggtaaggattgaaaacctaaattttaaggtcaattatcttaacttaatcgatagttgtctaagtataactaattgttatagttcatgaagatcaaaatatattgcattttccgcagtattgacagaaacagaagttagtaataaagcaacactatgggtatcagagaaatagttgataattcaagcgatttagaatttagaatcgttagattgatgctaatgccaatagaaatagaattaacttttattaaagaaatagctactattcctttagtctcagctcaaaattagtggactctctactaaattctgtttaggattgccttgttagttaataaattcgctattctcctgattatttttgcgaggagaaaagtcaagtatttacttttttaaaattatgtataaagatataattagtcaccgattaaaactttcattttaagatgatatgagtctaattgtgaacatggaaaagtcgggttttttaaattttacaacttttaggaaactgaaaatataaagtatgaaaaactttatttattcctgaagtcaataggacaaagttcgatgggcaaagggcaaaatgattttgcaagtaccttgacaaaccaaaaattactcgtcttaaaagactgagttttaaacccattgttctttgataaatgataaagaaacgataggataagttaataaaaaatgattttctgggaatcacaagaatttatgaagagatataaaaaaactttcctaagttaagaaaattaagaaaaactaatccatgagactacataaaaacaaggcaaaattttaagattgaactaacattaataattgatttctttaccataattactttgtcttttcataactaattgtgattaaaacagttgaaagtcagactctttttattagctttatatcgttaactaaacattatctgattgtgacaaatttaagcaaaatattttcaaaattatcaacacagaagcgaaaattttgtgaggatatcaatctagaatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctaatgcatattttaccctcgacaaatccaagaccatgcaacatttagggtagaattatttttatactcgtaatgtgattgatgtttataacccatgatttttcccgatttttctgcattttctaaccttgttcatcagggaaattttattcctgtttatcgagaattggtagcggatttagaaacccctgtttctgcttggtataaagtttgtgcagaccagccctatagtttcttgttagagtcagtagaaggtggggaaaatttaggaagatatagctttttaggttgtgatcctgtttggatactagaagcaaggggaaatcagaccaaacaagttcatcgtgatggtaaaatcgaaactttttcaggaaatccctttaacatcctctctcaatgtttagaaactattaaacctgttaaattaccagagttgccccccggtattggcggactatttggttattggggttatgagttaatttcttggattgaaccacgagtcaacgtttatcctgcctctgcggaaagtttacccgatggtatttggatgcaggtagataatttattgatttttgatcaagtaaaaagaaaaatatgggcgatcgcatatgcagatttaagacaggagcatttaagcctagaagaaatctacaatcaggcttgtgacaaaatttctaaattagttttaaaactacaattacctttaccagtatccgcaaaaccccttgaatttaaccccccgccaaaaactcaaaaaaatcatcgcattcaatacaaaagcaacaccagcaaagaggcattttgtgccaatgtggaaaaagctaaagaatacattaaagcaggagatatttttcaagtagtcatttctcagaaattacaatctcattatcaaggtcatccttttgagttgtatcgctccttacgtttgattaacccttccccttatatggcttactataactttcatggatggcagttaatcggctcttctcccgaagtaatggttaaagcagaaaaaactaatgatggtaaaaccaaagccgtagtccgtcccattgcaggaacacgtccaaggggcagaaactatcaagaagaccaatttttagcccaagacttactcaatgatcccaaagaaagggcagaacacgtcatgttagtagatttgggcagaaatgacttaggcagggtctgtgtaaaaggaagcgtggaagtcgatgaattgatggttattgaacgttattcccacgtaatgcacatagtcagtaacgttgtgggagagttagcaggggattactgtgcatgggatttactaaaggcggctttccccgcaggtacggtaagtggagctcctaaaattcgagcaatggaaattattaatgaacttgaacccgaaaggaggggaccttattctggggtttatggttactatgattttgaaggacagttaaatactgctatcacaattagaacgatggttgtggaaaccctttctgggacggaaaatcacttggtatccgttcaagctggagcaggcttagtcgctgactcagatccagacaaggagtatcaagaaactttgaataaagctagaggtttgctagaggcgattagtagcttaagctaagtgaaaattcgtaataaaaaagagcaaatttttgtgactttaaacctgacacctgaaatttatttttgaactccgaacccaaataatgattcaggttgcttaaactcagagaatcattaataattgattcttgttaactcaattgtcatttttaacatgggtgttgaactccgaagctatgtctatctcgatcgattacaacctcaacacgcttcctatataggtacggttgctctaggatttttacctttacccggtgatgcttctttatggattgaaatatcccccggaattgaaataaatcgaattactgatgtggctttgaagtctgctgg

SEQ ID NO: 91 - DNA, 4187 bp, Cyanobacterium sp. ABICyano1
tcgacttctgcaggaagttcctattctctagaaagtataggaacttctgagaaaaagtgtaaacaaatattaagaaaaagatcagaaaaatttaacaacacgtaataaaaaaatgcgtcactacgggttataaatttacatgaaaggttaaaacacttttctgagacgattttgataaaaaagttgtcaaaaaattaagtttctttacaaatgcttaacaaaaacttggttttaagcacaaaataagagagactaatttgcagaagttttacaaggaaatcttgaagaaaaagatctaagtaaaacgactctgtttaaccaaaatttaacaaatttaacaaaacaaactaaatctattaggagattaactaaaaccatggtaagatcaagtaacgacgtaacccagcaaggtagtagacctaaaacaaagttgggaggctcaagtatgggtatcattcgcacttgtaggttagggcccgatcaagtgaaatctatgcgagctgctttagatctttttggtagagaatttggtgatgttgcaacttatagtcaacatcaaccagattccgactatttgggaaatcttttacgttctaaaacattcattgcattagcagcatttgatcaggaagctgttgtcggtgcattagccgcttatgttttacccaagtttgaacaacctcgttctgagatctatatctacgatttagcggtatctggcgagcatcgtcgccaagggatagcaacagcgttaatcaatttgttaaagcatgaagctaatgctcttggtgcctatgtgatttacgttcaagcggactatggagatgatcctgccgtagccttgtataccaaacttggaattagagaagaagttatgcactttgatattgatccttctactgctacttaacaattcgttcaagccgagtcacactggctcaccttcggtgggcctttctgcgtttatatactagagagagaatataaaaagccagattattaatccggcttttttattatttgaagttcctattctctagaaagtataggaacttcatttaaattacgtacacggcggccggaataggaaatctcagttcagagttcggggtgttcactgcactagtcatgaacgggatttttaattcttaattcttaattcttaattatcaattatttaacgtcagttcgggtttgagaatgaaaaaaccctagggataaaggggggtttgcccctagccctttttataaaaaaagaattaaaagctaatcagaaatgaaaaaaataggcagtttaggagagaaaataattgcccagtggttaataaataaaggttattctgttatagaatcaaattggcattgtcgttggggtgaaattgaccttatagtaataaataaaagtttaaaagagattatatttgttgaagttaaaactcgcagtataaaaaattgggatgataatgggctatactctattaataacaaaaaacaagaaaaactctggttaacagctagtttatttttagaaaaaaatcaaatatttactgattggaactgtcgttttgatattgctttattaacttacaaaaaattaactaactttgggacagtattttctgttaacgataattgtttaagaccaaagtttaactatgaaggctatcaatttgaaattgttgattatttggaaaatgctttttaatctgatcttctgcacgtcaaatagtattctacaagacaattcagaatttagaatatattttttggcgttgcttaattatggtatgaaatttactgaaattatgccaaaaattgagacatcaaaatattatcattactgcaagaatgcccatttccccaaccccacctaaatgagaaatcatatacaaaactagtaaagcctatttttttgttacgagattatcccctaactttccattgaggaatcttcaattgtttatcaatgctttttctgctataattgcactcatggtaaggattgaaaacctaaattttaaggtcaattatcttaacttaatcgatagttgtctaagtataactaattgttatagttcatgaagatcaaaatatattgcattttccgcgatatcaatctagaatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctaatgcataactttcatggatggcagttaatcggctcttctcccgaagtaatggttaaagcagaaaaaactaatgatggtaaaaccaaagccgtagtccgtcccattgcaggaacacgtccaaggggcagaaactatcaagaagaccaatttttagcccaagacttactcaatgatcccaaagaaagggcagaacacgtcatgttagtagatttgggcagaaatgacttaggcagggtctgtgtaaaaggaagcgtggaagtcgatgaattgatggttattgaacgttattcccacgtaatgcacatagtcagtaacgttgtgggagagttagcaggggattactgtgcatgggatttactaaaggcggctttccccgcaggtacggtaagtggagctcctaaaattcgagcaatggaaattattaatgaacttgaacccgaaaggaggggaccttattctggggtttatggttactatgattttgaaggacagttaaatactgctatcacaattagaacgatggttgtggaaaccctttctgggacggaaaatcacttggtatccgttcaagctggagcaggcttagtcgctgactcagatccagacaaggagtatcaagaaactttgaataaagctagaggtttgctagaggcgattagtagcttaagctaagtgaaaattcgtaataaaaaagagcaaatttttgtgactttaaacctgacacctgaaatttatttttgaactccgaacccaaataatgattcaggttgcttaaactcagagaatcattaataattgattcttgttaactcaattgtcatttttaacatgggtgttgaactccgaagctatgtctatctcgatcgattacaacctcaacacgcttcctatataggtacggttgctctaggatttttacctttacccggtgatgcttctttatggattgaaatatcccccggaattgaaataaatcgaattactgatgtggctttgaagtctgctgg

SEQ ID NO: 92 - DNA, 6032 bp, Cyanobacterium sp. ABICyano1
tcgacttctgcaggaagttcctattctctagaaagtataggaacttctgagaaaaagtgtaaacaaatattaagaaaaagatcagaaaaatttaacaacacgtaataaaaaaatgcgtcactacgggttataaatttacatgaaaggttaaaacacttttctgagacgattttgataaaaaagttgtcaaaaaattaagtttctttacaaatgcttaacaaaaacttggttttaagcacaaaataagagagactaatttgcagaagttttacaaggaaatcttgaagaaaaagatctaagtaaaacgactctgtttaaccaaaatttaacaaatttaacaaaacaaactaaatctattaggagattaactaaaaccatggtaagatcaagtaacgacgtaacccagcaaggtagtagacctaaaacaaagttgggaggctcaagtatgggtatcattcgcacttgtaggttagggcccgatcaagtgaaatctatgcgagctgctttagatctttttggtagagaatttggtgatgttgcaacttatagtcaacatcaaccagattccgactatttgggaaatcttttacgttctaaaacattcattgcattagcagcatttgatcaggaagctgttgtcggtgcattagccgcttatgttttacccaagtttgaacaacctcgttctgagatctatatctacgatttagcggtatctggcgagcatcgtcgccaagggatagcaacagcgttaatcaatttgttaaagcatgaagctaatgctcttggtgcctatgtgatttacgttcaagcggactatggagatgatcctgccgtagccttgtataccaaacttggaattagagaagaagttatgcactttgatattgatccttctactgctacttaacaattcgttcaagccgagtcacactggctcaccttcggtgggcctttctgcgtttatatactagagagagaatataaaaagccagattattaatccggcttttttattatttgaagttcctattctctagaaagtataggaacttcatttaaattacgtacacggcggccgcgaataggaaatctcagttcagagttcggggtgttcactgcactagtcatgaacgggatttttaattcttaattcttaattcttaattatcaattatttaacgtcagttcgggtttgagaatgaaaaaaccctagggataaaggggggtttgcccctagccctttttataaaaaaagaattaaaagctaatcagaaatgaaaaaaataggcagtttaggagagaaaataattgcccagtggttaataaataaaggttattctgttatagaatcaaattggcattgtcgttggggtgaaattgaccttatagtaataaataaaagtttaaaagagattatatttgttgaagttaaaactcgcagtataaaaaattgggatgataatgggctatactctattaataacaaaaaacaagaaaaactctggttaacagctagtttatttttagaaaaaaatcaaatatttactgattggaactgtcgttttgatattgctttattaacttacaaaaaattaactaactttgggacagtattttctgttaacgataattgtttaagaccaaagtttaactatgaaggctatcaatttgaaattgttgattatttggaaaatgctttttaatctgatcttctgcacgtcaaatagtattctacaagacaattcagaatttagaatatattttttggcgttgcttaattatggtatgaaatttactgaaattatgccaaaaattgagacatcaaaatattatcattactgcaagaatgcccatttccccaaccccacctaaatgagaaatcatatacaaaactagtaaagcctatttttttgttacgagattatcccctaactttccattgaggaatcttcaattgtttatcaatgctttttctgctataattgcactcatggtaaggattgaaaacctaaattttaaggtcaattatcttaacttaatcgatagttgtctaagtataactaattgttatagttcatgaagatcaaaatatattgcattttccgcagtattgacagaaacagaagttagtaataaagcaacactatgggtatcagagaaatagttgataattcaagcgatttagaatttagaatcgttagattgatgctaatgccaatagaaatagaattaacttttattaaagaaatagctactattcctttagtctcagctcaaaattagtggactctctactaaattctgtttaggattgccttgttagttaataaattcgctattctcctgattatttttgcgaggagaaaagtcaagtatttacttttttaaaattatgtataaagatataattagtcaccgattaaaactttcattttaagatgatatgagtctaattgtgaacatggaaaagtcgggttttttaaattttacaacttttaggaaactgaaaatataaagtatgaaaaactttatttattcctgaagtcaataggacaaagttcgatgggcaaagggcaaaatgattttgcaagtaccttgacaaaccaaaaattactcgtcttaaaagactgagttttaaacccattgttctttgataaatgataaagaaacgataggataagttaataaaaaatgattttctgggaatcacaagaatttatgaagagatataaaaaaactttcctaagttaagaaaattaagaaaaactaatccatgagactacataaaaacaaggcaaaattttaagattgaactaacattaataattgatttctttaccataattactttgtcttttcataactaattgtgattaaaacagttgaaagtcagactctttttattagctttatatcgttaactaaacattatctgattgtgacaaatttaagcaaaatattttcaaaattatcaacacagaagcgaaaattttgtgaggatatcaatctagaatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctaatgcatattttaccctcgacaaatccaagaccatgcaacatttagggtagaattatttttatactcgtaatgtgattgatgtttataacccatgatttttcccgatttttctgcattttctaaccttgttcatcagggaaattttattcctgtttatcgagaattggtagcggatttagaaacccctgtttctgcttggtataaagtttgtgcagaccagccctatagtttcttgttagagtcagtagaaggtggggaaaatttaggaagatatagctttttaggttgtgatcctgtttggatactagaagcaaggggaaatcagaccaaacaagttcatcgtgatggtaaaatcgaaactttttcaggaaatccctttaacatcctctctcaatgtttagaaactattaaacctgttaaattaccagagttgccccccggtattggcggactatttggttattggggttatgagttaatttcttggattgaaccacgagtcaacgtttatcctgcctctgcggaaagtttacccgatggtatttggatgcaggtagataatttattgatttttgatcaagtaaaaagaaaaatatgggcgatcgcatatgcagatttaagacaggagcatttaagcctagaagaaatctacaatcaggcttgtgacaaaatttctaaattagttttaaaactacaattacctttaccagtatccgcaaaaccccttgaatttaaccccccgccaaaaactcaaaaaaatcatcgcattcaatacaaaagcaacaccagcaaagaggcattttgtgccaatgtggaaaaagctaaagaatacattaaagcaggagatatttttcaagtagtcatttctcagaaattacaatctcattatcaaggtcatccttttgagttgtatcgctccttacgtttgattaacccttccccttatatggcttactataactttcatggatggcagttaatcggctcttctcccgaagtaatggttaaagcagaaaaaactaatgatggtaaaaccaaagccgtagtccgtcccattgcaggaacacgtccaaggggcagaaactatcaagaagaccaatttttagcccaagacttactcaatgatcccaaagaaagggcagaacacgtcatgttagtagatttgggcagaaatgacttaggcagggtctgtgtaaaaggaagcgtggaagtcgatgaattgatggttattgaacgttattcccacgtaatgcacatagtcagtaacgttgtgggagagttagcaggggattactgtgcatgggatttactaaaggcggctttccccgcaggtacggtaagtggagctcctaaaattcgagcaatggaaattattaatgaacttgaacccgaaaggaggggaccttattctggggtttatggttactatgattttgaaggacagttaaatactgctatcacaattagaacgatggttgtggaaaccctttctgggacggaaaatcacttggtatccgttcaagctggagcaggcttagtcgctgactcagatccagacaaggagtatcaagaaactttgaataaagctagaggtttgctagaggcgattagtagcttaagctaagtgaaaattcgtaataaaaaagagcaaatttttgtgactttaaacctgacacctgaaatttatttttgaactccgaacccaaataatgattcaggttgcttaaactcagagaatcattaataattgattcttgttaactcaattgtcatttttaacatgggtgttgaactccgaagctatgtctatctcgatcgattacaacctcaacacgcttcctatataggtacggttgctctaggatttttacctttacccggtgatgcttctttatggattgaaatatcccccggaattgaaataaatcgaattactgatgtggctttgaagtctgctgg

SEQ ID NO: 93 - DNA, 8367 bp, Cyanobacterium sp. ABICyano1
tcgacttctgcaggaagttcctattctctagaaagtataggaacttctgagaaaaagtgtaaacaaatattaagaaaaagatcagaaaaatttaacaacacgtaataaaaaaatgcgtcactacgggttataaatttacatgaaaggttaaaacacttttctgagacgattttgataaaaaagttgtcaaaaaattaagtttctttacaaatgcttaacaaaaacttggttttaagcacaaaataagagagactaatttgcagaagttttacaaggaaatcttgaagaaaaagatctaagtaaaacgactctgtttaaccaaaatttaacaaatttaacaaaacaaactaaatctattaggagattaactaaaaccatggtaagatcaagtaacgacgtaacccagcaaggtagtagacctaaaacaaagttgggaggctcaagtatgggtatcattcgcacttgtaggttagggcccgatcaagtgaaatctatgcgagctgctttagatctttttggtagagaatttggtgatgttgcaacttatagtcaacatcaaccagattccgactatttgggaaatcttttacgttctaaaacattcattgcattagcagcatttgatcaggaagctgttgtcggtgcattagccgcttatgttttacccaagtttgaacaacctcgttctgagatctatatctacgatttagcggtatctggcgagcatcgtcgccaagggatagcaacagcgttaatcaatttgttaaagcatgaagctaatgctcttggtgcctatgtgatttacgttcaagcggactatggagatgatcctgccgtagccttgtataccaaacttggaattagagaagaagttatgcactttgatattgatccttctactgctacttaacaattcgttcaagccgagtcacactggctcaccttcggtgggcctttctgcgtttatatactagagagagaatataaaaagccagattattaatccggcttttttattatttgaagttcctattctctagaaagtataggaacttcatttaaattacgtacacggcggccgcccgcagtattgacagaaacagaagttagtaataaagcaacactatgggtatcagagaaatagttgataattcaagcgatttagaatttagaatcgttagattgatgctaatgccaatagaaatagaattaacttttattaaagaaatagctactattcctttagtctcagctcaaaattagtggactctctactaaattctgtttaggattgccttgttagttaataaattcgctattctcctgattatttttgcgaggagaaaagtcaagtatttacttttttaaaattatgtataaagatataattagtcaccgattaaaactttcattttaagatgatatgagtctaattgtgaacatggaaaagtcgggttttttaaattttacaacttttaggaaactgaaaatataaagtatgaaaaactttatttattcctgaagtcaataggacaaagttcgatgggcaaagggcaaaatgattttgcaagtaccttgacaaaccaaaaattactcgtcttaaaagactgagttttaaacccattgttctttgataaatgataaagaaacgataggataagttaataaaaaatgattttctgggaatcacaagaatttatgaagagatataaaaaaactttcctaagttaagaaaattaagaaaaactaatccatgagactacataaaaacaaggcaaaattttaagattgaactaacattaataattgatttctttaccataattactttgtcttttcataactaattgtgattaaaacagttgaaagtcagactctttttattagctttatatcgttaactaaacattatctgattgtgacaaatttaagcaaaatattttcaaaattatcaacacagaagcgaaaattttgtgagggaattgaatgccaaaacaaataataattgcagaaaaaaatcatatagcggcagtatttgctgaagatcaaattcaagaattagtggttgctaccggaaaccaacaggtaggagatatttatttaggaacagtcgaaaatgttatttcgggtattgatgcggcttttgtcaatataggcgatgcggaaaagaatggttttatccatgttactgatttgggtcctttacgattaaaaagaagcgcaggggcaattactgaattattaactcctcatcaatccgtattggttcaagtaatgaaagaacctacaggaacaaaaggacctcgtttgacaggtaatattagtttaccggggcgttatttggtgttaatgccttatggaaagggagttagtctttctcgacgcatcaagaatgataatgagcgtaatcgccttagagcattagctattcttttgaaacctgcggggatgggtttgttggttcgcacagaagctgatggtaaaggagaagatgcgattattgaggatttggagtttctcaaaaaacagtgggaaaaaatccaacaggaagcgaatactttaaatcctcctgcgttgttgaatcgagatgatgatttcattcaacgggttttgcgagatatgtatagtgacgatgtcaatcgtattgtagttgattctgacgatgcagtaagaagggttaaaaaacagttaaataattggggaagtggtaaaaatcctcatggtttattaattgattctcatcaggatagccgttctattttagattatttccgagttaatagtgccattaaagaagcattgaaaccgagggttgatttaccttctgggggatatattatcattgaacccacagaagcattaacggtaattgatgttaactctggctcttttactcattcagcgacttcccgagaaacggttttatggactaatactgaagctgcgatcgaaattgctcgtcagttaaaattacgtaatattggtggggtgattgtggttgacttcattgatatggattctcgccgagataaattaaaattgttagagcattttaaccgagttttacaaagcgataaggctagacctcaaatcgcacagctatcagaattaggattagtggaactaactcgtaagcgtcagggtaaaaatatttatgaattatttagtcaaccctgtagtcattgtggtggtttaggcttagtgggtcatttccccgggcattatgatttagaaagtcttacttccaataattattatcaacctcctcaaattagcaaaacagagaagcctattctcgatgaaaaaattatttctcttgatgattttagtagcgataatgatgagttagatttagttaatcatcctagttatcaagaaagcaacaatggtaatagtcgtcgccgtcgtcgtcgtcgagaaaatggggtgaaagaagagcctattttagcgggaagtaatggtaatgggggagagactgaaagtaagcctgaaagaaaagagcgtagtttattatctcgttctttacgcagagatgaaagtcagtgggaaaaagtagtagtagaaatgactcctgcggagcaagatgtttatgcttttatgggggtttctcctttactccgtttagaacaagaatttaaagaccctaaatcggttttagtttatgtgcgtaatccagaggagcaggaaaatatagaaaatatagatactgccatggaaaaaaatcagcaagaggatatagaaatagctgatgatgaggacaaaaatgcgatcgaggtagctcccgccgccgaggttattttcccccaagggaaggaaacgatggtaaatgaattagaaattgatgtacaagtgggagaagtggatgagcaaatagaattagaggaagatgaccactttgaggaaagttccaaagaagtctttgatggtgataatagtgaaactgctgaagaaactattactgatgccattataaaagaggctttagagagcgatcgccccgttgtcagaacccgtcgtcgtcgcacttctcgtaattcttgattttagttaactaacctcagttcggtttaagaatatccgataaggttaggtgttaggtgtcaggttgcaggaacagcaggtggtaggggtgaataaatatatttaacgtcagttcggattaaggcaattttatcgttatttctaagttatttctaagaagctataaggttttttgactacgagttggtctgctttcgatatcaatctagaatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctaatgcatcctttaaggattggtattgaggctttaaatcaagaatgggaattttcatgaatgactactaagaggatgattaatctaagagtttacactattttttcatcggaaaaaaccatcatcattcagaagattgagaaggaggatttggggtgtttgtagatggattattttgctgtgctaaaccttgtttaataaaacttagggcttcttgataactttgattttctggttgaagacttactaatttttccattaggggtagggcagaagctaaatctccaccagacagataaatttgaactagcttttctaaggcaaaaatgttatcaggctctctttgcaaaaccaatttataaccctgagcctctttttctaaaattgcttgagccgaatcaggttcttgttgttgaggttgattggcattactaggacttttcaacatttttacaacgccaaaaattgaaaaagagaaaaaagaaagcccagataaaattactaaaaccctacgaagaacttgtttaggagtggtttttttatttgtgttaaccattagttatagaaatattttaagcaagtgtcattaactattttaccctcgacaaatccaagaccatgcaacatttagggtagaattatttttatactcgtaatgtgattgatgtttataacccatgatttttcccgatttttctgcattttctaaccttgttcatcagggaaattttattcctgtttatcgagaattggtagcggatttagaaacccctgtttctgcttggtataaagtttgtgcagaccagccctatagtttcttgttagagtcagtagaaggtggggaaaatttaggaagatatagctttttaggttgtgatcctgtttggatactagaagcaaggggaaatcagaccaaacaagttcatcgtgatggtaaaatcgaaactttttcaggaaatccctttaacatcctctctcaatgtttagaaactattaaacctgttaaattaccagagttgccccccggtattggcggactatttggttattggggttatgagttaatttcttggattgaaccacgagtcaacgtttatcctgcctctgcggaaagtttacccgatggtatttggatgcaggtagataatttattgatttttgatcaagtaaaaagaaaaatatgggcgatcgcatatgcagatttaagacaggagcatttaagcctagaagaaatctacaatcaggcttgtgacaaaatttctaaattagttttaaaactacaattacctttaccagtatccgcaaaaccccttgaatttaaccccccgccaaaaactcaaaaaaatcatcgcattcaatacaaaagcaacaccagcaaagaggcattttgtgccaatgtggaaaaagctaaagaatacattaaagcaggagatatttttcaagtagtcatttctcagaaattacaatctcattatcaaggtcatccttttgagttgtatcgctccttacgtttgattaacccttccccttatatggcttactataactttcatggatggcagttaatcggctcttctcccgaagtaatggttaaagcagaaaaaactaatgatggtaaaaccaaagccgtagtccgtcccattgcaggaacacgtccaaggggcagaaactatcaagaagaccaatttttagcccaagacttactcaatgatcccaaagaaagggcagaacacgtcatgttagtagatttgggcagaaatgacttaggcagggtctgtgtaaaaggaagcgtggaagtcgatgaattgatggttattgaacgttattcccacgtaatgcacatagtcagtaacgttgtgggagagttagcaggggattactgtgcatgggatttactaaaggcggctttccccgcaggtacggtaagtggagctcctaaaattcgagcaatggaaattattaatgaacttgaacccgaaaggaggggaccttattctggggtttatggttactatgattttgaaggacagttaaatactgctatcacaattagaacgatggttgtggaaaccctttctgggacggaaaatcacttggtatccgttcaagctggagcaggcttagtcgctgactcagatccagacaaggagtatcaagaaactttgaataaagctagaggtttgctagaggcgattagtagcttaagctaagtgaaaattcgtaataaaaaagagcaaatttttgtgactttaaacctgacacctgaaatttatttttgaactccgaacccaaataatgattcaggttgcttaaactcagagaatcattaataattgattcttgttaactcaattgtcatttttaacatgggtgttgaactccgaagctatgtctatctcgatcgattacaacctcaacacgcttcctatataggtacggttgctctaggatttttacctttacccggtgatgcttctttatggattgaaatatcccccggaattgaaataaatcgaattactgatgtggctttgaagtctgctgtagtcagaccgggagttcaatttgtggaacgtctttatggtttattggagattcattctagtaatcaaggggaagtaaaaacggctggaatggcgattttagatgctttaggtgtgagtgaaaaagattctcttaaaccagaggtggtttctagccaaattattcgcaatattgacccttatcaagcccaaatcattaatcgtaatcgtcgaggacaaatgttgttagcaggagaaactctttatgtgttggaagttaaaccagccgcttatgcggcattggcggcaaacgaagcggagaaggcggcgttgattaatattttgacggttcaggcggtgggtagttttggacgactttatttaggaggtgctgaaagggatattaaagcgggggcggcggcggctttagatgcgatcgcaaatatcggtgggagagtaagtgtttcaaaaataaatgaataaaaaaactctttgtttatgggaattataaataatcctcatcctcagataagttaagg

SEQ ID NO: 94 - DNA, 7151 bp, Cyanobacterium sp. ABICyano1
tcgacttctgcaggaagttcctattctctagaaagtataggaacttctgagaaaaagtgtaaacaaatattaagaaaaagatcagaaaaatttaacaacacgtaataaaaaaatgcgtcactacgggttataaatttacatgaaaggttaaaacacttttctgagacgattttgataaaaaagttgtcaaaaaattaagtttctttacaaatgcttaacaaaaacttggttttaagcacaaaataagagagactaatttgcagaagttttacaaggaaatcttgaagaaaaagatctaagtaaaacgactctgtttaaccaaaatttaacaaatttaacaaaacaaactaaatctattaggagattaactaaaaccatggtaagatcaagtaacgacgtaacccagcaaggtagtagacctaaaacaaagttgggaggctcaagtatgggtatcattcgcacttgtaggttagggcccgatcaagtgaaatctatgcgagctgctttagatctttttggtagagaatttggtgatgttgcaacttatagtcaacatcaaccagattccgactatttgggaaatcttttacgttctaaaacattcattgcattagcagcatttgatcaggaagctgttgtcggtgcattagccgcttatgttttacccaagtttgaacaacctcgttctgagatctatatctacgatttagcggtatctggcgagcatcgtcgccaagggatagcaacagcgttaatcaatttgttaaagcatgaagctaatgctcttggtgcctatgtgatttacgttcaagcggactatggagatgatcctgccgtagccttgtataccaaacttggaattagagaagaagttatgcactttgatattgatccttctactgctacttaacaattcgttcaagccgagtcacactggctcaccttcggtgggcctttctgcgtttatatactagagagagaatataaaaagccagattattaatccggcttttttattatttgaagttcctattctctagaaagtataggaacttcatttaaattacgtacacggcggccggttgatgaaattgtggagtagggtgggcaatgcccaccattaagactcaaagagagaactatgccacaggttgcttactactagcctcttttgctaagaatttttccaactctgttaaagcatccgcatctactttagtttgcataggacagaatttaggaccacacatagaacaaaattctgcttctttataaatatccgcaggtaatgtttcatcatggtattctcttgccctgtctggatctaaagatagctcaaattgacgattccagtcaaagttataacgagctttagaaagttcatcatctctatctcttgcaccggggcgatgacgggcaatatctgccgcatgagccgcaattttataagcaattaagccattacggacatcttcggcgttaggtaagcccaaatgttctttaggggtaacatagcatagcatcgcagtaccataccaaccagccatagccgctccgatcgcacttgtgatatgatcataaccgggagcaatatctgtcaccaaaggacccaaaacatagaaaggagcttctgagcattcttccatttgttttttcacattgaactcaatttgatccattggtacatggccaggaccttctaccattacttgtacatcatgttcccacgcacggcgagttaattgccctaaagtttttaactctgataattgagcctcatcagaagcatcatgggtacaaccggggcgtaaagaatcacccaaactgaaagaaacatcatatttcttaaagatttcgataatatcatcaaaatgggtgtaaaggggattttgtttatgatgatgcaacatccaacgggcaataataccaccaccacgggacacaataccagtgatacgattacgtactaaaggcaagtattcaattaaaatacctgcatgaatagtcatataatcaacaccttgttgagcgtgtttttcgatgatgtgtaaaaagtcatcggcggtaagattttcgatttttccgtgtacactttctagggcttggtaaataggaactgtgccaatgggtacaggagaagccttaataattgctgtgcgaatttcatctaaattaccgcccccagtggataaatccatgacggtatctgcaccatattttaccgctaagtttaatttagctacctcctcatcaatattagatgagttaggagaagcaccaatattcgcatttaccttacacttagaggcaataccaatgcacataggctcaagattggggtgattaatattagcaggaataatcattctgccccttgccacttcatctcgaatcaactcggcaggtaagttttctcttgtcgctacatagtgcatttcttcggtaataacaccttgacgagcatagtgcatttgagacacgttagcttgtccacgacgtttcgctatccattctgtacgcatattttttcctctataaacagctttcctacgctggtattacccagtctcaggttctaagggtttttctcagcctaacaaattagacacccctagctatgtgctaaattgtatcattatttgagtgagaatggctaatagtcaactccaatccccaattgctatttctcaacaatagatgtatgattatagagtagatacagttaagaaaatcttaaacaatcacactacttacttaaaacaatcgtatcattttcatgagacataggcacattagtcccgatagcgcccttggtttggtttctacttacagctttcctgccattgtgggaacggctgacatgatgttgaaatctgctgaggtgatgttagtaggttatgagaaaattggtgcgggacattgtactgctattgtcaggggaagaatcgcagatgtgcgtttggcggtggaagaaggggcgaaaatggcggagcaaataggtcaattacacacaaaattaattattcctcgcccgatgcctaatttagaggcagtttttcccattggtagccgtttggtggaggtagcacaacaaaaaagagggtttagccgtttaagtaatcgttcgattggtttgttagaaacaaaaggatttcccgctatggtgggagcggctgatgcaatgttaaagtcagcagatgtgcagttagcttcttatgaaactattggggcggggttgtgtacagtgatagttaggggttcagtggcaaatgtagcagttgcgatcgaagctggaatggctgaagcagaaaggattggcgacttgaatgcggtgatgattattcctcgactcctagaagatttagagcatactttacccgttgctaactattggttagagcaagaaaataaagagcatcctttacctacatttacgtcgagacagaaagaaagagcaaaacgtaaattagtggcattacctgaattagaaaaaatccctcttacttttgaaacaagagaaaaagttaagcaagaggcaaaattagaatctcagttagagttaagttctgagttggagttgagtcctgaaagtgatgatgagatatcaatctagaatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctaatgcatgatgaatatagggtttctggggtttgttcactctcttttgggtcaaacaataatgtcagtagttcatataagctaatacccatgtattgagccaaattgtttaaattattaatagtaggcagtctctctcttcttatccaaccgtttaagctgaaagctgagactcctatttcctttgataaatctctataacttttctctccctttatcccatccaaaatattggataatctttcataaacatattcatatccttgcattagtatattctctcttaaatcgtatttcttggacattgccgtctagtattaatatcttatcgactaatagccatactatgttttttttatcagatggattcaacgtttcccagaatagtggagacgataaaacggcttccaactttttgttgtggatttttgagtaagtgacagactctagtttgcggatttggctttctatttcccttattgccttgtctatggctggattactcggtatcgctaataatgcctccctctgactccttaactttaataattctggtgtttctctctttgtattttttttgcttattaatgtcaatatatcccctgaatgttttattaactctcctataaataccttatctatcttttccagtcttgtgtattttgaatttgtacattttatttttttgtttatttttcccctacaacgataatatttacttggtgcattattcagtatgttacaggatgctccgcaataagcacaatagactttaccactgaaggggtatatagtgccaccactatgtcttctagtatgtttagactgattaaaggttaaatttatctcctgcctaacagagggtgatattatcggttcgtgggtattataatgaatctcacctgtgattttatataccgtatgaccatctaagactggattttgtaaccaagccctcaaaccttgatagctcaacattcctactccatagtattctagtatcaacgttagggttttgcctacagatttacacttaaggtacgtatctattattctctgtgatattttatatttactatattcttgtctatcttttatggtacacagatatggtttatggtctaggacatatttgccattcttaagagcataaccaaaagaaggtttaaacatcattagtttattatcccttcgatgttgaaatccgtgttttatcttctctgataacctatcactctcactttgggcaaaactcgccaatatattaaagtgtagtctcccatccactgtactcatgtctattttgtcatctaatgctcttagagtacaattatattcttccatttgctttactatcttatttagttctaatacacttcttcccaatctgtcgagtcgggttataattacttcattcactattccttgtttaattaagcatatcaatgattggagtccttccctttctttgtctttgtaccccgactcgacatctactattatcctttctaccccctccctctctatcctttgcctttgttgttccaacgcatttgatttttccgattgttcccttgtgcttacccggcaatatcctatacgcatctttatgttttcttctcttttctatagtctattttatattttcctacagctaattgaacatgaatttaaaacagaatctaattgaattgccttcggatttgaatgcaaaaataattcctcatcatgtagcagtgataatggatggtaatgggcgttgggcaaaacgtcggggtttccctcgtattgtaggacatcaaaaaggtgttgacactctgaaaagtttattacgttgttgtgacgattggggtattaaagttttaactgcctatgctttttctacggaaaactggggaaggcctgtaactgaggtagaatttctcttaactctttttgaaagggttttaagaaaagaattagcacagatgatggaaaaaaatgtcaaaatccgttttatcggtgatttaaaggctttaccagagtctttacaggcagaaatctatcattcaatggaagagactaaatataataagggtattaagtttaatattgctactaattatggtagtcgtcaggaaattctccaagcctgtcgtacgatcgcatcttctgttcaagagggtaaaataaatttagaagatatagacgaggaattatttgaaagtcatctttacactaacggcttagaatccccagatttattaattcgtaccagtggtgaaatgcgtttgagtaactttttgttatggcaaatggcatacagcgaaatttatgtaactaatactctgtggcctgattttaatcgggaagaattccatctggctttgctcaattatcaacaaagagacagacgtttcggcaaggtgaaagaataaaaataattaagtaccgtaaatcattagtttattaaggaatgacacataatttaccccgtcaacgg

SEQ ID NO: 95 - DNA, 7139 bp, Cyanobacterium sp. ABICyano1
tcgacttctgcaggaagttcctattctctagaaagtataggaacttctgagaaaaagtgtaaacaaatattaagaaaaagatcagaaaaatttaacaacacgtaataaaaaaatgcgtcactacgggttataaatttacatgaaaggttaaaacacttttctgagacgattttgataaaaaagttgtcaaaaaattaagtttctttacaaatgcttaacaaaaacttggttttaagcacaaaataagagagactaatttgcagaagttttacaaggaaatcttgaagaaaaagatctaagtaaaacgactctgtttaaccaaaatttaacaaatttaacaaaacaaactaaatctattaggagattaactaaaaccatggtaagatcaagtaacgacgtaacccagcaaggtagtagacctaaaacaaagttgggaggctcaagtatgggtatcattcgcacttgtaggttagggcccgatcaagtgaaatctatgcgagctgctttagatctttttggtagagaatttggtgatgttgcaacttatagtcaacatcaaccagattccgactatttgggaaatcttttacgttctaaaacattcattgcattagcagcatttgatcaggaagctgttgtcggtgcattagccgcttatgttttacccaagtttgaacaacctcgttctgagatctatatctacgatttagcggtatctggcgagcatcgtcgccaagggatagcaacagcgttaatcaatttgttaaagcatgaagctaatgctcttggtgcctatgtgatttacgttcaagcggactatggagatgatcctgccgtagccttgtataccaaacttggaattagagaagaagttatgcactttgatattgatccttctactgctacttaacaattcgttcaagccgagtcacactggctcaccttcggtgggcctttctgcgtttatatactagagagagaatataaaaagccagattattaatccggcttttttattatttgaagttcctattctctagaaagtataggaacttcatttaaattacgtacacggcggccgaattaatggtttttcagagtgtggttatgataaattatgtcttaaaaaggtttcaggtggcaggtagcaggtgtcaggttaaataaaaataaaaaatttataaaatttaagttttaaaatccccttttccctttttcaacgaacaatttatcacgacgagaagtgatagagtcaaattaattagttagaactaaagagagatttaactaatgttttagttttttcgtctaaagtctgccagtttaactgtccatcctcttcaaaaagagttttatcagttgttacaggttgagtagtgctttctgaatagttattgaaacaaacttgaaaacataactcccaaacattatttttttctgttttattttcctttttaatagcaacaatataactgggaaaaggttcattaatttcttcataactaacatcataattagataattctgactccttacgaatattatctaagagacgaataaaaatgggttgcattaatacttgtgctaattcatattcttgggcgtttttaaatttaggttcaatcatggatttctttttgatatttaatacttctatatattagttagtttgataaactattttataaataattctgctgatggttagtattttttgaacattactaatattatttttcaattgtcgatatttttctttaatttttttgatttctaaagctgttgttagaatagataaggaaacctctttgataattaaaggtaagtttttattgatataaattagcctagtattcagagtctttaaatattttttgattctgatgagttgccataataaataaaaattaattacacaaataaatatattaaaagatagtataaaaattaaagacatcaactacttatatttaagtttaaaaaataaaattgtacctgccaaaattaaggtaacaatattcgtaactaggacaggaatatccatgataaataatccataaataatccataaaataacccctaaacaaaagcaaagaaacatggctaaagatatatcttttgcagatttacttctccaagttttaatcgcttggggcaaaaaagaaatagtggtcaaactaccagccatcaaacctataattgttatccattccatatatttttattaaacattaattattaataaatgaagttattttacagtagttatgatcaataatatttctcaaaaaagtttcaggtggcaggtgtgaggttgttgggaggaaacaagtaatgagttaggatttaggagttaggggtttttaatttttaattcttaattcttaattatcaactatttacctttgcccttttccgtaacttttaattacaatttgatatttttcaatgacaaacgaggatcatcttgactaattgagcgaattttttcataatattctttttcctgatcagaaatatttttaggagttgcgatcgcaattttcactaataaatcaccattacccccttttggattactccagcccttgcctttaagacgtaaagactgcccgtgacgaatacccgcaggaattttaaccataacttccccttcaggagttggcacattaacttctcctcctaaaacagcctcataaggagtaattggcacttcacacactaacttatcatcctcaaaagagaaaaaatcatgaggctttaattcaacctttaaatataaatctcctttatgattactgatagggttaatttgcccttttcctttcaatctgacttttgtgccattttttgcccccgcaggaattttgacagtaacgatttctgaacctaaatctaattttgtctgtaccccatgataggcttgataataggtaagagtaatgcttttttcaatatcatttcccctcccttgactagcagttgtaccagtattaaaaccgccaaaatcactaaaaccagtagtttgagtgcgtgtattaccaaaaggtcttcctagtaaatcagcaataaactcgtcaaagctattatacttaccaaaatcaaaatccatatcattagaacttcgtgtttgataggtattaccccaagtcgatgtatttctgcttgtagttctttgtcccatgggtctgccataacggataaattggtcatattttttccgcttttccgtatctcctaaaacctcataagcctcgctaatttccttaaatttttcctctgccgctttgttatcaggatttctgtcagggtgatatttaacggctaatttacgaaatgctttttttatctcctctccagaggcttttttatctactcctaacactgaataataatctttgaattccattccttgcatagttgattttttcttctcaggttaaaataatattctatactttgatcacaaataacataaagttactatttcttgtaaaaaagtcggggatagtcgaaaagatgtagtgattgagatatcaatctagaatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctaatgcatagaagttaaaatgatgatcggagtattgcgaaaaagagataatttgcgtaaactggcacaaatctcataaccgttagtatctggcattactaagtctaaaaaaatcatatctggttttgaggctaaaattttggcgatcgcctttaggggttctgtaatacctaaaaatctgtatccagcttttttaagaataatattcatggtttcgcaaattagagggctatcatcgatacaagcaatcaatggtgttgctgtttccgcttcttggacttctgtaactggggaaatgggtgcaggtaaatcagccacagaaactaaatcaatgtaaccttgttgaatataggggagtaaagaactactaaactggggtaaatcccgtttaaattgtaccgctaaatctcttagagtgttcctaccattgaataatttttggaaaatttcataggttttcggtgatgtttttgcttgtaattgttttgcagagcgtattacaggggctttgttaggactgcgatcgcctaatcttaagttaacccattgttgccattgttgccatgcgggtacgataacttgacttgcgtcaagaagacaaatttgctcctcaaggggaatatgtaccttactattaagaaaaaaactgatttccagagtttgattgagatcaaaaaaaatctcgataaagatattattcaccattttgataacgccatctctaccaactttgccttctaaaagccaatgacgcaccaactcatattcccaacaaaacttaatcttgtccgaagagatagattttatttcctgctctaaaaaaacttgatctgatgccacttccggaagaaaagccgctaaattacgacgccaacgcctgacagaatgattccctcctgtagcacaaatcaatctacccatataaagataaaatcgccattgttcttttcccggatgtactaactgtaattcaccactaaactgatgctttttcaaaacattaaacagataactttgttttgatgccacaaaacctttaatgggaatactactatgattttcttggtttggcgtttccattagtggtatatcaaatctattcgagctttaattatgttgatcttagtataatatttcaattaggaattagtaattatcatctaaaatccaatacctaaaatccgaaaccaaaagctctacacctaaataatgcgtactattaacgaaattaacgaaaaaatactacagaaaaaagcaagagtttgcaccatcgaagaattaaaagcgaaagtaaagaaaataggcataaagaaaacttatgaaaaagtcgatgtaatttgtgctggtacttttgaacccatggagtcttcaggggcaattttaaatcttggtcataccgatccccccatgaaaatacgtcattgttggttagatggtgttcctgcctatgctggttttggagctgtggatctttatttgggggcaacggctttgcctgatgtcaatgatgcggaaaatacggttattcctgaaaagggaggggctcatgtgattgaaagtctcattgcgggaaattctgtttccgttaaagccatcggacaagttactgattgttatccccgtgcttctttcgatgcaacgattaatattaactccataaatcagttttacttatataatcctcgtaatttgtatcaaaattttattgtgggggtgaatggaggcgatcgcatcttatatacttatttaggacctttgttgcctcgcttaggtaatgcggtttattctaatatcggggctttatcacctcttttaaatgatccttacctagaagcgatcggtattggtacaaaaatattcttagggggtgcagagggtatgataacgtgggagggtactcaacattttcccttacaaaaaagaagcactaatggtactcctattgggcctgcttccactttagcattagtaggagatgcaaaaaaaatggatcgtaaatgggtgaggggttgctactttaaaaattatggagcatctttaatgttaggggtggggattcctttccccgtgttaaatgaaaaaatcgttgaaaattgtgcggtggaagataaagatatttatgctcccgtgatggacttttctattcctcgccgagtgcgtcctagttttggtttagtcaattatgctcaacttaaacagggtaaaatcaaaattgaaggacaaatagttaaagtagcttccgttgctagtctttatctttctcgtcaggtagcagaaaccttaaaacagtggattttggatggtaaatttactttgactgaagcagtttctcctttaccttcatcgacaacttttatttctcaggatggtgtcaattaacttctgtttggggagtaatcttagaagttaagaagtaatagtaatgagtaatgagttgaaatcagaagttttttattcttcattattattgtggaaatataagtcatgtataaaagtagtattttatggtgttttaatcctgatgaaaatataccagag

SEQ ID NO: 96 - DNA, 6173 bp, Cyanobacterium sp. ABICyano1
tcgacttctgcaggaagttcctattctctagaaagtataggaacttctgagaaaaagtgtaaacaaatattaagaaaaagatcagaaaaatttaacaacacgtaataaaaaaatgcgtcactacgggttataaatttacatgaaaggttaaaacacttttctgagacgattttgataaaaaagttgtcaaaaaattaagtttctttacaaatgcttaacaaaaacttggttttaagcacaaaataagagagactaatttgcagaagttttacaaggaaatcttgaagaaaaagatctaagtaaaacgactctgtttaaccaaaatttaacaaatttaacaaaacaaactaaatctattaggagattaactaaaaccatggtaagatcaagtaacgacgtaacccagcaaggtagtagacctaaaacaaagttgggaggctcaagtatgggtatcattcgcacttgtaggttagggcccgatcaagtgaaatctatgcgagctgctttagatctttttggtagagaatttggtgatgttgcaacttatagtcaacatcaaccagattccgactatttgggaaatcttttacgttctaaaacattcattgcattagcagcatttgatcaggaagctgttgtcggtgcattagccgcttatgttttacccaagtttgaacaacctcgttctgagatctatatctacgatttagcggtatctggcgagcatcgtcgccaagggatagcaacagcgttaatcaatttgttaaagcatgaagctaatgctcttggtgcctatgtgatttacgttcaagcggactatggagatgatcctgccgtagccttgtataccaaacttggaattagagaagaagttatgcactttgatattgatccttctactgctacttaacaattcgttcaagccgagtcacactggctcaccttcggtgggcctttctgcgtttatatactagagagagaatataaaaagccagattattaatccggcttttttattatttgaagttcctattctctagaaagtataggaacttcatttaaattacgtacacggcggccgccttcagttcggtttaagaatatccgataaggttaggtgtcaggtgtcaggttgcaggttgcaggtgagagggggaagtcggggcttagggttttaggggggtaggggtgaatatatttaacgtcagttcggattaaagcaattttatcgttatttctaagaagctataaggttttctgactacgagaaaataatgctttcagcttatccaaaactcaagttaattaaaaaagggcaaaggtaaatagtgttggggtgaatagtgaataattaataattaataacttctaactcttaacccctaactcctaactcctaactcctaactcctaactcatttctccctctctccctattcccttatcccccaatcaggacttaatttcccgtaccaaagttatactaacccatcttccttgatcatcatattgtctaattaaacgtaatctcatattcgtttctactaaccaaccaaattcaagaaagaaactttgacgattttcaatttttacaggagtggtagaagatgcaccatcgggcaaaagcaaaactcgattttctttatttccctgattaaatgtaatgatgttatcattgatagtgcctccagaagaatagttcataaaaggggtttttagggtttgtttgagagtgtttccttctcgttttaaagttaattgagtttgatatggttcactattacgccagtctggatataatgttagcgcttctcctcgccattctccttctagttgttcaatggtaagatgctccctctctattccttctcctccctcccgaaattctcgaataagagtaacagagtcgaaattactatctttgtcaaacaattgtactaatctacaacggcgatcgcgccttacgtaaccatattctgccccgaaaacggaaaaaggactaaactgttgagagcctttggcaaaatgaccatcttcaaataaaaatatattacgattcaggctactaaattcattgactacaggattagggtttccatctctagccagagtaaatctaatggttttaccatcatcactaccgagagttaatttactggaagtctctttgagtaatttaccgtgaggagaaaactgactgaacgagcctaaccaaactcctgagttttttagtaaataagaccactgtgaggaagacataagacgatattttaattaaattaactgagattattttgttataaaactacgaacatcaggctataatatactatcataaatattgctaaaatttcccttaattgatactaataaaattgttagaatgaaccagtcaaaagaaatagataaagagaatttagttaaagaggttgctaaaataaaatactggcatcattacatagattttggtgcaggggtagaaacaaaaacaggaaaagaaggacgattttgtaagaaatttcaaaactggattttaagtggtattcctcaagatttaacaggaaaaactgttttagatattggtgcatgggatggtttttattctttttctgcggaaaaaaggggggcaaaaagagttttagccacagattcttttatctgggaacagaggcaattatatggtttagatgataatttttggcgtgattttggagcgggaaaacagggttttgaattagcaagaaaaatgtttaattcccaagtagaggattacaatattgatgttttagatcttaatcctgaaaaaattggtacttttgatgtggtattttttttaggggttttatatcacatgaaatatcctctttatgctttagaaaaagtaagaagtgttaccaaagagttgcttattttagaaactcatataagtttattttttagcttatttcctgtacctttaatgcgcttttatcctactaatgaattaagtaaagatgtaacaaattggactggtgcaaatatcgctttggttaaatcatggttgttaaccgcaggttttagtaaagtggagttagtcaaatggcggatatcaatctagaatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctaatgcatcattcgcccgtacaagagttaggagtttttaattcttaatttttcccttgccctttttactttgccttttgcccattgctctttgtatgacttgttggagaagtctattgataactcatggggtcaaatagagatactatccaacctaattttatcgcttctgagatgcgatcgagggtttcttctcgactaaaaccaaaatgggtttcttcctgaagaatagcagtaacgcttaagtgtccattacaacttcttaacaaacgggcttcatcttcgctaatagttcttatttccacttgattatcaggtttgcgccaaatcaaataaggctttctttctcctgcaatgaggtgtctgggttcaatggggcatttatgggctttggtgaggggaactaagcaataacaggaaaagggaatgcgagtaccatgttctaatttggggcgataaccatgaagtttttttactcggagacggtgtaataattcctttggattattttttcttaaagtaggggctgtttctgctcttcttagtcgccattcggtgagagcaacatcaattaatagtcttgaccaatcaatagtttgttcttctatagtaggtatcaaaggctcgaaaaattctggtttaactacggtgagataatccataaaactattggcatagtctaaaacggtgacattatcacaatgactatgaaggtaaaaatcatcgacgaagcgatcgaataattctgatcccataatcgcttcacaggcaggaaatatctcatgaaaaggtgcgatcgttctcgttctagccctatttaagtataagtctaaaacctcttctgtgtttctttgatgagcgggaataataatactttctaaccaaggagaatttttgtctgttctcaaacttttgagaaattgctgttctagctttaaaagggtgggtgatttcatgaaattttaggaatattaaccaatgtaaagaagaatggatattttatagaccaagtttatcatatggattcgcaagaaaataattaagcaatgattaaaatcagggaaaatacggaaaacaatacctagatattttcggttttctctccctattaaataagaaggatatgacaagataaaaataacaattgaaaattaaataaatatcaattgaaacagaatttgttaggaggtaaaagtatggctattgttcgttttaatcctttgtatgaaattaatagcttacatcgtcaaatgaatcgactactagatgaaataactgcatgggatgatactcctaattcatttctcaaacctgcagtagaattgttagataatgacaatagtttaatgcttaaagttttagtacccggaattgacaaaaaagatcttgatgtcagtgttacccgtgatagtgtgaaggtaagtggtgaataccatcgtcaagaagaaaataaagatactggttactacatttctgagtttaattacggtaaatttgaacgcacaattaatttaccattaccgatcaaaaatgaccaagtaaaagcagaatataatgacggtgtcttaacgttaattttaccaaaacttgaagacgagaaaaataaggtatttaaagttagtttaggagcagaggaaaaaccagctttagaatcagaaagtaatggctaatattgttctaaaaaaggtttaatgcttactaaataaataattaatttgcctgtctcaaaaagacaggttttttttatgaaagtaataagaaataagtagaagtgaggagttggaaagataggattaagaattaggagttaactattttcattctttattcttccattgcccattgagaaatcatatctaaaatcagcaacgccaaattttagatgcaaaataaccataaataaaatgcagaaaaaagaatactttagatcttccgtatcagaagatacatttcttaacaaaatctggtgacaagattaaacacacgaaatccgaggttttatatattgattagtcctagg

SEQ ID NO: 97 - DNA, 6225 bp, Cyanobacterium sp. ABICyano1
tcgacttctgcaggaagttcctattctctagaaagtataggaacttctgagaaaaagtgtaaacaaatattaagaaaaagatcagaaaaatttaacaacacgtaataaaaaaatgcgtcactacgggttataaatttacatgaaaggttaaaacacttttctgagacgattttgataaaaaagttgtcaaaaaattaagtttctttacaaatgcttaacaaaaacttggttttaagcacaaaataagagagactaatttgcagaagttttacaaggaaatcttgaagaaaaagatctaagtaaaacgactctgtttaaccaaaatttaacaaatttaacaaaacaaactaaatctattaggagattaactaaaaccatggtaagatcaagtaacgacgtaacccagcaaggtagtagacctaaaacaaagttgggaggctcaagtatgggtatcattcgcacttgtaggttagggcccgatcaagtgaaatctatgcgagctgctttagatctttttggtagagaatttggtgatgttgcaacttatagtcaacatcaaccagattccgactatttgggaaatcttttacgttctaaaacattcattgcattagcagcatttgatcaggaagctgttgtcggtgcattagccgcttatgttttacccaagtttgaacaacctcgttctgagatctatatctacgatttagcggtatctggcgagcatcgtcgccaagggatagcaacagcgttaatcaatttgttaaagcatgaagctaatgctcttggtgcctatgtgatttacgttcaagcggactatggagatgatcctgccgtagccttgtataccaaacttggaattagagaagaagttatgcactttgatattgatccttctactgctacttaacaattcgttcaagccgagtcacactggctcaccttcggtgggcctttctgcgtttatatactagagagagaatataaaaagccagattattaatccggcttttttattatttgaagttcctattctctagaaagtataggaacttcatttaaattacgtacacggcggccgcggtggtttaagattcggaattaggaaaaaggtttcagatgtttttaattattaattatcaactataaactattcaccattgcccattgccctttttataattcataattcactatcaactaatcatgatttagtcaaattctagtaaactttaaaggttagggtgttttgatttcctacagctaagtataaaatagactatcttttttattgttttatcaaatctttacataaagcaattgacttttttttcagacgtttctatgatttatataacactcgtatgtttgataggtataattcaatgccaagaagaataataaacattgataaaagaccaaaaaacttctacttaaaacaggaaacagtagatgagataaagagactatcgtatgagtacgacactacacaatctattgttttatcagtgttggtggacaacaaaccaccgaaagcagtactggaaaaaatgattgcaaaggaaaaagaaaatcatggctatatctgaagcagtccatatctacctcaatattgtcaaagaacatcaccttgatgaactttgttgtatggtcttaccgacaaaaaaagactgctgtacagaaccttgcattaattaccaaatcgctaaaaggaagattgtacgctcaatgaaaatgatagaaagtaaatctgcgtttctcaacaaactaaacgagattgctgacaatgttgattctctaatccaatacttctcagaatctgaaaactctaaacattatcaacaggtggttggtgaatatatcgaaaccattcactgccaaatctatgaactaaacaacctacataaagagaacaaaaacaatggataagcctatatattaccaaataactagagaagaactatcagaaatgagagagttaatgaacaatatatctctggtatatcttgttcttaaactagaaaacccattctgtgaccgtcctatcaaaatcaaccccataaagattgcttcggattggaatatctctacaagcagtgtctatgaaactatcaacactctcagaaaaaaaggattagacatacaaactatacaatcacccattgaacaaggagaataattatggatactgcttttttcaaactaactccagaccttgtacttaaaatctctcaacttaaccttaatcagtctgaattaaaactctggatgtacttgtcatctcttgaaccatttggggatagacggataatgttacctacttcccaagatatggctaaacgtcttaatatgtcagttgcttctttcttccgtgctaaagctaaattgcaagaacttcaacttttctcattcttcgacaaatatactgagttcattaataatcttggttataattctcatcataaattagtacatcaaaaccagtctcaaatctgcgatagtgactctcaaatctgcgatagtaactctcaaatctgcgaggtagtatctcaaatttgcgatactacaaatcaaatctgcgatagtgactctcaaatttgcaaaaacgaacctttgaaacccttacaagacaaagattttgactcctctcagactattaagactattaagactatctcatactcctcagacagagaaacactcttgaaagagagagagaatattgatttgtcttttaaagaagacggggaaacctacaaggtttgcccacaggtggcaaacacagcccctcattgtggtcaagatgataaggtaaataccgaaagctctaagacaacaaacctaaatactcaggttatctctcaagacaatagtgtaaataaccctgtctcaacacaagctagtcaacataacactttttctgctgaacgtagtgcagttgaaaacacccagattcacaagaagggattagtagcgatgtcggatgttatacagcaatcgcctaatactcctcctaatccatctaaggtacaaataaaagcatgggaatggttgcccgatggagaatggaaggttgaccataaacttgaccctattttccatgactggttagccgatatcaatctagaatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctaatgcatcggggacaaatgtaaattttctgctactttaatttttgattcaataataaaattcatttattccatgaacaattaactatgtctttatctttaatagacatctggtggaaaatattaatataggctcgtagttagggctttagcccttattttgagaattgttggagatgtctaattattatgattttaatattggtttgtagttagaattttaacccttatatattaaacatttggaaaaaataatttttttactttaaactttttggctcttctacaatggttattataaattaatagaaaagaatttctgtaatgcctactgaatattattcatggcaaaatacaaactaaaaatttataaattattatttaataattgcctatttcttaacaaacatcaataatttacacgacgagaagtgatagagccataattttagttatttatatgatttaaaaaaaatcatttgtcaattattttatcctacttctttgatttaggtagatgagtaataccggcgttagcaaataaattaagtttgccttctgagatgctaattttatctacttgtaaataaattccatctattaataaattttctaaatttaaaacttttcccacttctgctaataaaatctttactactgttgctgaccaactttctccttgagtacaagcaaattcatctaaaataataccttttttatgctgacaaatacgaggctttataattaaacaaatactctctaatttattactattttgttcttttaatttagctttaatcgcaattctaccatcagacaaaatccgaaaatctactcttttaaaaaatacttttgatgcggtagggtattgtcctaatttactattaagattatcaacatttaagattgtttcaatatctgtttcgttaagaataatacgggcttttcctcgactaggttgggttaattccacatttcccattaaagccttaaaaggactaacagcaatatcattgagggtgattctcattttttccaaagggagattttcccgcatcattaaaccatttccatcaatatctaatgattctaaaatccccttggctaattgttgtggatttgtttttacttgtacacttaggtatttagcagatttgatttgacttttaaaagccatttccgcaattttattgatagttttttccccaatagtgtcgaatttgcccagtaacatattgatttattataaaaataagggtttttacttaaattttagagttattttaacatttttctgagaataaggtttaataaaacttaatgaaaaagtagtttaactgagagtacaagatttgagtaagattaactcaatgtgaaaaatattgatacttgacggagattaattccatgacagagttacctatttatgatttagtgattaataatggattattcgctcaaatggtagaagaccctgatattttaggtcaaatgtctgatgcttggaaaaattttgttgaatctggacaaatttgggctttgttgattggtgtattttttggttatatttttgcttcttttactcgtttttagaacaattaaagttataaataatggctctatcagtttgagtatgtaaattattagttagggtaggctgaaaggcaagaggcaataggggattattaaataataatttataaacttttagtttttattttactataaacaccatttaataaaggttatggaagtcctgtttctcttaattcatcataaccacactctgaagaacctaaataattaatttgtttattttcacctctttgattgattaataaatgttcagaaaatctttaccgtcaaacctaccaccatgagggttgaacattcttcaacccctaaaatctgtccttatctgatatttttgccgaaaaactgaggtgattttggtcaattacaacactaactagatgacatttttaatatttgattcaataatatttactacgttagttgattattaattttgaactgtgacg

SEQ ID NO: 98 - DNA, 5935 bp, Cyanobacterium sp. ABICyano1
tcgacttctgcaggaagttcctattctctagaaagtataggaacttctgagaaaaagtgtaaacaaatattaagaaaaagatcagaaaaatttaacaacacgtaataaaaaaatgcgtcactacgggttataaatttacatgaaaggttaaaacacttttctgagacgattttgataaaaaagttgtcaaaaaattaagtttctttacaaatgcttaacaaaaacttggttttaagcacaaaataagagagactaatttgcagaagttttacaaggaaatcttgaagaaaaagatctaagtaaaacgactctgtttaaccaaaatttaacaaatttaacaaaacaaactaaatctattaggagattaactaaaaccatggtaagatcaagtaacgacgtaacccagcaaggtagtagacctaaaacaaagttgggaggctcaagtatgggtatcattcgcacttgtaggttagggcccgatcaagtgaaatctatgcgagctgctttagatctttttggtagagaatttggtgatgttgcaacttatagtcaacatcaaccagattccgactatttgggaaatcttttacgttctaaaacattcattgcattagcagcatttgatcaggaagctgttgtcggtgcattagccgcttatgttttacccaagtttgaacaacctcgttctgagatctatatctacgatttagcggtatctggcgagcatcgtcgccaagggatagcaacagcgttaatcaatttgttaaagcatgaagctaatgctcttggtgcctatgtgatttacgttcaagcggactatggagatgatcctgccgtagccttgtataccaaacttggaattagagaagaagttatgcactttgatattgatccttctactgctacttaacaattcgttcaagccgagtcacactggctcaccttcggtgggcctttctgcgtttatatactagagagagaatataaaaagccagattattaatccggcttttttattatttgaagttcctattctctagaaagtataggaacttcatttaaattacgtacacggcggccgcagttttatttctgaaggggggacaataactctaaaaaccttataggtagcaggtggcaggtattaggtgttaggttttgtatccattaatatttatcattatctccatttactcaatggttcaaataatgggcaaaactattggattatcaacattttgagataatatgtctggctatttatttcgtaaatacaaaatactgttcatgtatttaaaacctgcaacctgaaacctgaaacctctttccgaaaccctaacaaccaaatacttgaatatctttaaaagcacatacgggagaggcatggccaaccctaatggcttgatttggctctcccttgccacagtagggagttccataaaattctctggtggattcattccccacataaatgagattgtgccagaaatgttgggttactcctcgatagttggggtttctcagggttttagtaattttaccgttttcgattaattgggcatattcacaaccgaattgaaatttgttgcggtagtcatcaatagaccatgagcggttagatttcatataaactccaaattcgatcgcactaataatctcatggaaactactattacctgattctaagtttaaattagccatgcgatcaatggaaggacgattccaagaggaagagcgaaaattagccactccttgaatatttgacctctgctgactttcaaggctacctaatcccctaagtaagataccgtctttaattaagtattgtttttctgcttttagccctgcatcatcgtaaccataactggcaaattcccctttaacagtaggatcaaaggtaatattcatcaagggcgaaccataggcaagagtaccaaaatctgacaatttgacaaagctacttccagcgtaattacgttcatctcccaaaatgcgatcgatttccaaaggatgacctacactttcatggatttgcaacatcatttgatctggtgctaaaacaagggtagtagtcatgttcggacagtcttgggcaaaaactaactctaccgcttcttctcctatttgttgcacacgattgagggtaatttcagggttaaaaacttcctttcctgcttgataacatctagctaacattccgttatcacttcttttctgaataatattaccatcttgtgcgatcgcagcataatcagtttccacaagggaaaattgctgttgaatattcgccccattactactaacaaaatgagaggaaatatcactaattcctgccatagccgtagctttaaccactttatccgacacccgaaggcgatgacaaatttggactaataaatcatttaactcttggggatgaactaaattagcagattcagtaataggggattgataacttccctttgcgggaggtctaatatctgtattaaatttaaaaatactccatttactcgctttttcagcttgttgttgagcaacttctgccgcctgttgaattgcagattgattcaaatgattagtcgcacaatagcctatttgtccattaaccattacttccaccattactccatgatttattttcctgccgttactttggggtttgccgtctcggaaaatacgatgagtagtggtttcgtaaacttgtcttaatccgatccagtctgcattaatatcaagattctcaagggttttttcaagatctaacatttatttataatcaattattaactgatgttacgcaaaaagataattagttgttgttttgaggtatcaggtgtcaggtatcaggtgtcaggtatcaggtgtcagaaaaattcacccgatatcaatctagaatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctaatgcattagactggaattgtactttagaactaattgagccagtatcaaaatcttgtaaatatattggcattagagctcatcatcttctttttcccaatataaatcaagagcatcaaatcaatactttttcttgttggttagcaacaattagtgaaactcaacatcgtgtgacactatacctcaagttaaacctaccaactaatcatcaggaagactataatctacaagcggaagtgttaaaagataaatggatggaattaaaagataaccctttcccttggaaaattcaaattttacccccaacaattatggtatttgataattaagggttgccgaaaaagtattttggtgaggggataaggtgagaggggataatgttcgataataatataacctagtcaaataggaaagaagctatttttatgaatcatacaaacagaagtcttgattggtttttgattacccttgtggtaggcattagtggttttggtagcttaatcatttataccacccaattatataaacagggttcggattggcaacaacaattaattatggtggtgattggaagtgctattttacttgggctatcttattttccctatgaattactactaaaatttcattggtttacctatggtttcacaaacttattattagtggctgtaattttttttggtactactattaatggggcgcaaagttggatttatattggtagctttaattttcagccctcagaatttgccaaaattggtttaataattaccctagcggctctattgcattttcgtgatgcttcaagggtatcccgtttatttcccattgcatcaacggttgcgttaccttggttattaattatggcacaaccagacttagggacagggttagtatttggggcgattactttcacaatgctttattgggctaacgctaatttaggttggattttattgattctttctcctctggtatctgctttcctattcaatttatttctcccagcatggttaatttttacggtggttatgattatcattgcttggtttactttacctagaggggctatttgggcattaattaccctgacagtaaattacatggctggaattttagggcatattttatgggacttgctcaaaccttaccagaaagaccgtttaactttatttttagaccctgaaaaagatccgttaggggggggataccatttaattcaatctcgcattgctattggctctggagagctttgggggaatggtttatttgagggtactcaaactcatcttaattttgtccctgaacaacatacagactttatttttagtgctattggtgatcaattaggctttgtcggtgcgatcgcaactttaatagtttattggtttatttgtttgcgattagtaatcatcgccaatagggcaagagacgattttggctctttaatcgccattggagttttaggaatgattgcctttcaaaccattatcaatatcggtatgactatcggattagcacccatcacaggaattcctttacctttacttagttatggacgttcatccctacttagtaattttatcgcttttggtatcgtagaagcgatcgcggctaatattcccaagaaaaatacatctttccgttaatcaatatttttcactattcactatagcgattctaaggggcaaaggaagaatcaagaattaagaattaagaattaagaattaagaattaaaaactccgaacacttattacttatctattatttattactggtttccccctctcccctcatcccatcatctccctatctcctaaacaccatgatacctgcaacctgaaacctgaaacctgacacctacctttactcgatatttttaaactgagctaaggttaactagaaacattcagactttagaaaataacagcttaagagtatgatagaaaattggtctatactaaacttttattgataatgacgag

SEQ ID NO: 99 - DNA, 6157 bp, Cyanobacterium sp. ABICyano1
tcgacttctgcaggaagttcctattctctagaaagtataggaacttctgagaaaaagtgtaaacaaatattaagaaaaagatcagaaaaatttaacaacacgtaataaaaaaatgcgtcactacgggttataaatttacatgaaaggttaaaacacttttctgagacgattttgataaaaaagttgtcaaaaaattaagtttctttacaaatgcttaacaaaaacttggttttaagcacaaaataagagagactaatttgcagaagttttacaaggaaatcttgaagaaaaagatctaagtaaaacgactctgtttaaccaaaatttaacaaatttaacaaaacaaactaaatctattaggagattaactaaaaccatggtaagatcaagtaacgacgtaacccagcaaggtagtagacctaaaacaaagttgggaggctcaagtatgggtatcattcgcacttgtaggttagggcccgatcaagtgaaatctatgcgagctgctttagatctttttggtagagaatttggtgatgttgcaacttatagtcaacatcaaccagattccgactatttgggaaatcttttacgttctaaaacattcattgcattagcagcatttgatcaggaagctgttgtcggtgcattagccgcttatgttttacccaagtttgaacaacctcgttctgagatctatatctacgatttagcggtatctggcgagcatcgtcgccaagggatagcaacagcgttaatcaatttgttaaagcatgaagctaatgctcttggtgcctatgtgatttacgttcaagcggactatggagatgatcctgccgtagccttgtataccaaacttggaattagagaagaagttatgcactttgatattgatccttctactgctacttaacaattcgttcaagccgagtcacactggctcaccttcggtgggcctttctgcgtttatatactagagagagaatataaaaagccagattattaatccggcttttttattatttgaagttcctattctctagaaagtataggaacttcatttaaattacgtacacggcggccgacattatataattggctctgttactttgaatatgatacatcaccgtcttgtcaattaaagtttgtgctaaatgtatattaaagacattggcgaacatcaattattatcaatcataaatcagtattgtgaccaaaccattaatggtgacgatggagcaattatcgcttttgatagtggtaaaaacttagtcgttaccactgatattttagtcgaaaatgttcatttcagcgatcgcactacacctccagaatccattggttatcgtggtgtaactgctaacttgtcagatatagccgctatggggggaatgccaataggtattaccgtaggtttatccctcagaggtgacacagaaattaactgggtagaaaaactttatcggggaatgaaaaaatgtttaactccatataacatcaatattgttggtggagacataactaaatctgaaactaacactatctccattacagccttgggaaaagtttctgcatctcacagtatctatcgccatcaagcacaagtgggcgatgtcattttagtgacaggtaatcatggactgtcaagggcagggttagaaatccttctctttcccgaaaaatatagtcatctaccctcacaaatcagagaaaaggttatttttgcccatcaataccctaaaccccgcttagaggtcataaaatacctatatgaactatgtcaatatggttatcgcattgcaggaatggatagtagtgacggattagccgatgctattctacaaatatgccatcaaagtaaagtaggggcaagactcgatcgcacctcaataattgttgatgaagcaattacgactattatcgggagaaaaaccgcttttgagtgggtgctttatggaggagaagattttgaattagtattatgtttacccttaaacttagctaagaaaatccaacaagaatttggagaaaaatgtcaaattattggtcaaataacatcatcattagaagtacaaataattgatcaagaaaatagcaatttacaactctcattaaatcagaaaaaaactttccagcatttttagttatactaatttatagcttaatgtacctgattagcttattattaaataatataagtattgttattaatatagtccatctactccccgtaatctttgagcgttaatcaaatcatgattaaaattttagtagtcgatgataatcacacacccagagaagtgatcagcgaagcactgaaacagtttaatatccaagtaaccgaagcatccaatggggtagaggcaaccaaaataattgagaaagaaaaatttaacctcgtaattactgatgtagtgatgcctgaaatgaatggctatgaattatgtcgttggataaaaagtaatccaggaacagaaaaagtccctgtaatcatttgctctacaaaaggagaagaatttgatattcactgggcaacaaaacaaggggcggatgcttatattattaagccttttaaaacgatggaattattaaaaaccattaaatatttacttaagcataatgtaggataaaactacctcttgaaaataacagtagaatacaattttcataatttaaaatcaatttggttctcttttcccttgtttgctgacttcaacaaaaaaatctaatcgggaattaggaacgataaatcagcaactataaacgaataaaaataagcgaactagcttaccattatgacaaatacaaatgtaattgtaatcggcggaggtttagctggtacagaagcaacgtggcaaatagctcaagctggtgtgcctgtaaccctttacgaaatgcgccctgtaaaaaatagccctgctcatcatagctcagaattagcagaattagtttgtagtaattcctttggtgcagatgcctttgatcgagcggctggtttattacatgaagaattacgccgtcttaactccattatcattcaaactgccgatgaacacaaagttcctgcaggagggatatcaatctagaatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctaatgcatgtaatatcttagggcagttaggtgcaggtttaattactccttctgcggtagatgaattactccataactggcaaggaagattacaagagtctgctaatgtgccaaatttattcgccttagttttggctttacaaacagaggaaatccccgaagatatagcgactcaaaaggttttaactatttttgatcttccccaagattttgatttaactaaaacacccttatcacctaccgatgatcctattttaagtcaacaggtactaattttagaaaatcaactcactttgctatatcaattaggggggcaagttttacaaagtgcaggtattaccgactctcacgaagcacaatggttaattagtcgtgccactgctgaatatatttatcataatcctgacatcgatttaactgattcccaagtcattaaccaaattattgattctgcaattctcttttccacccttacagtggaagattctatcatagaaagtaaacgcgatcgcattgcttccgtaaatacaaccttagatgtaattaatcagggaaataataactatgaggaattagcgaatcaacaacaacaaattctcgataatgtcttagaatactcctctccctatcactatcctttacccttagttgtcaatcaaaatgaagaagaaaccctttacacccctcagcccattgatactaagtttcaaatatccgcccttaatgtatccgataactatgagttaggtatcaaaacccctgacggtgaatcgattatcctcttagaaaacttgcccggtagcgatgattctactttaactaatactttagatgagattaccgtagataccttaatgggtagtgaaaccaagttttttggctcattaattaacgcaccagagggtttagctacttttaccgatagtggtttagaattttatcttactattaatggtgaaacttacagttcacaaaatccagaacaactggaaattacctctaaaggcagtcaaggtttagccttaacttttaaagacgaaaatgacaccgttgcggaatttgccattaacacaccggtttttctcacccccggtttagacaagggcgagaataccaccattaatcttactattgcccgaagtgcggcgaatgaaaacaccatcggtatttaccaagtggatgatttaacaggaggaattataagaggcgatcgcactatcatgcccaatgatcccgaatatgataaaatagccattcagaaggcacaatcttcgggattaatatttgaaacccccgaaaacatgaacatagataactacaccatcgccttacctaatgctagtatttttggtttcttccttctggttaatggcaacacagaagaatatttgaatcaaggagaagaattagaagaatcaatttacagctttttctcttatggcagtgccaataaagacaacaggcaacattttacctcccttggcgataatatttttggctttgaggatacctttggtggaggtgataatgattttaatgacattttattgcaaatcaattatacagaggtttagctgtcattaacgttttttcttttaccctaacctctgttttgaaacaaaacctgataataaatatctccgaaaaacgaaggattagggtaaatactttgatttatgaacattttgaattacttggtgactcttacctttaccaatttcacttttttgcaatccctaagtataatttttggctctatcacttctcgtcgtgtaaattattcgttagggtaggcaagaggcaagaggcaagaggcaataggggattattaaataataatttataaacttttagtttttattttactataaacactattcaataaaggttatagaagttattttttattaatttatcataaccacactctgaagaacctaattttttaatgcagaattttgctaatttattttaacccacagatttctgcttggtagagatgtgctaatatagcattg

SEQ ID NO: 100 - DNA, 13083 bp, Cyanobacterium sp. ABICyano1
tcgacaattaataacttcttcctgtacgggcgaatggccatttgctcctaactaactccgtactgctttgcggaacgagcgtagcgaactctccgaattactaagccttcatccctgatagatgcaaaaaacgaattaaaattatgtgtaaaaagaaaatgtgtctttatttagtagtcaaagttacaaaatattaagaatcaaattaataatgtattgggcagttaagtatataagtctttaaatatttatttgtattcaatatattaaggaggatcagccttatgaattcttacactgttggaacctatttagcagaacgtttagttcaaattggtctcaaacaccattttgcagtagctggtgattataatttagttttattggataacttattgttaaataagaatatggaacaagtgtattgttgtaatgaattaaactgtggtttttctgctgagggatatgctcgtgcaaaaggtgctgccgcagcagttgttacttattctgttggagcattaagtgcttttgacgctattggaggtgcttatgcagaaaatttacctgtaatcttaatctctggtgcacccaataacaacgatcacgctgctggtcatgtattgcatcatgctttaggtaaaaccgattatcattaccaattagaaatggcaaaaaatattaccgctgccgcagaagctatttatactcccgaagaagcacctgctaagatcgatcacgtaattaaaaccgctctccgtgagaaaaaacccgtatatttagaaatcgcttgcaatatcgcttctatgccttgtgcagctcctggacctgctagtgctttatttaacgatgaagcatctgatgaggctagtttaaatgccgctgttgaagaaactttgaaatttattgctaatcgtgataaagtagctgttttagttggttctaaactccgtgccgctggtgcagaagaagcggctgtaaaattcgcagatgccttaggaggtgctgttgccacaatggcagccgctaaaagttttttccccgaagaaaatcctcattacattggtacttcttggggtgaggtatcttaccctggtgtagaaaaaaccatgaaggaagctgatgcagtaattgcattagctcctgttttcaatgattactctaccactggttggactgatattccagaccccaaaaaattagttttagcagaacctcgctctgtagttgtgaatggtgttagatttcccagtgtacatctcaaagattatttaactcgtttagctcaaaaagtgagtaaaaagactggcgcactcgatttctttaaatctttaaatgctggtgaattaaagaaagcagctcctgctgatcccagtgctcctttagtgaatgccgaaatcgcaagacaagttgaagccttgttaactcctaacactaccgttattgccgagactggtgatagttggttcaatgctcaacgcatgaaattacccaatggtgctcgtgttgagtatgaaatgcaatggggtcacattggatggtctgttcctgctgcatttggatatgcagttggagcacctgagcgtagaaacattttaatggtaggtgatggttctttccaactcactgctcaagaagttgcacaaatggtacgtttaaaattgcctgttattatctttctcattaacaactatggttacaccattgaagttatgattcatgatggtccttataataacattaagaattgggattacgcaggtttaatggaggtatttaacggtaatggtggatacgacagtggagcaggtaaaggattaaaagctaaaacaggaggtgagttagctgaagcaattaaagtagctttagccaatacagatggtcctaccttaatcgaatgtttcattggacgtgaagattgtactgaagagttagttaaatggggaaagcgtgttgccgctgcaaattctcgtaaacctgtaaacaaactcttgtagttaggatccagcaaggtttcatcccgaccccctcagggtcgggatttttttattgtgagctcaactttagatattcgtagttggcaatgtcgtaaatgcggaacaatacatggaaaacatatagatttgtaatgagaaaaagtgtaaacaaatattaagaaaaagatcagaaaaatttaacaacacgtaataaaaaaatgcgtcactacgggttataaatttacatgaaaggttaaaacacttttctgagacgattttgataaaaaagttgtcaaaaaattaagtttctttacaaatgcttaacaaaaacttggttttaagcacaaaataagagagactaatttgcagaagttttacaaggaaatcttgaagaaaaagatctaagtaaaacgactctgtttaaccaaaatttaacaaatttaacaaaacaaactaaatctattaggagattaactacatatgagtgaaactaaatttaaagcctatgccgtaatgaatcctggtgaaaaattacaaccctgggaatatgaacctgctcctttacaggtagatgaaattgaagtaagagttactcacaatggtttatgtcacactgacttacacatgagagataatgactggaatgttagtgagttccccttagtagcaggtcatgaagttgttggtgaagtaaccgctgttggtgaaaaagtaaccagtcgtaaaaaaggtgatagagttggtgtaggttggattcgtaattcttgtcgcgcttgtgaccattgtttacaaggagaagagaacatttgtagagagggttatactggtttaattgttggtcatcacggtggatttgctgatcgtgtacgtgtacctgctgacttcacttataaaattcctgatgctttagatagtgcatctgctgctcctttattatgtgccggtattaccgtttacactcctttaagaacctacattaaacatcccggtatgaaagtaggtgttatgggtattggaggattaggacatttagctattaaatttgctcgtgcaatgggagcagaagttactgcctttagtaccagtcctaataaagaagcccaagccaaagaatttggtgctcatcatttccaacaatggggtactgctgaagaaatgaaagctgttgccggtaattttgatttagttttatctaccatctctgctgaaactgactgggatgctgccttctctttattagcaaataacggtgttttatgtttcgtaggtattcccgttagttctttaaatgttcctttaattcctttaattttcggacaaaaatctgttgtaggttctgtagttggaggaagaagattcatggcagaaatgttagagttcgccgctgtaaatcagattaaacctatgatcgaaactatgcccttatctcaagtaaatgaagctatggataaagttgccgccaataaagccagatatagaattgtattattatctgaataactagatctacttctaaactgaaacaaatttgagggtaggcttcattgtctgcccttatttttttatttaggaaaagtgaacagactaaagagtgttggctctattgctttgagtatgtaaattaggcgttgctgaattaaggtatgatttttgacccctgcaggatcatcttgctgaaaaactcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgccctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttgaatatttttcgtcagatacgcaaaccttacaaacataattaacaactgaaactattgatatgtctaggttttagctctatcacaggttggatctg

SEQ ID NO: 101 - DNA, 13071 bp, Cyanobacterium sp. ABICyano1
tcgacaattaataacttcttcctgtacgggcgaatggccatttgctcctaactaactccgtactgctttgcggaacgagcgtagcgaactctccgaattactaagccttcatccctgatagatgcaaaaaacgaattaaaattatgtgtaaaaagaaaatgtgtctttatttagtagtcaaagttacaaaatattaagaatcaaattaataatgtattgggcagttaagtatataagtctttaaatatttatttgtattcaatatattaaggaggatcagccttatgaattcttacactgttggaacctatttagcagaacgtttagttcaaattggtctcaaacaccattttgcagtagctggtgattataatttagttttattggataacttattgttaaataagaatatggaacaagtgtattgttgtaatgaattaaactgtggtttttctgctgagggatatgctcgtgcaaaaggtgctgccgcagcagttgttacttattctgttggagcattaagtgcttttgacgctattggaggtgcttatgcagaaaatttacctgtaatcttaatctctggtgcacccaataacaacgatcacgctgctggtcatgtattgcatcatgctttaggtaaaaccgattatcattaccaattagaaatggcaaaaaatattaccgctgccgcagaagctatttatactcccgaagaagcacctgctaagatcgatcacgtaattaaaaccgctctccgtgagaaaaaacccgtatatttagaaatcgcttgcaatatcgcttctatgccttgtgcagctcctggacctgctagtgctttatttaacgatgaagcatctgatgaggctagtttaaatgccgctgttgaagaaactttgaaatttattgctaatcgtgataaagtagctgttttagttggttctaaactccgtgccgctggtgcagaagaagcggctgtaaaattcgcagatgccttaggaggtgctgttgccacaatggcagccgctaaaagttttttccccgaagaaaatcctcattacattggtacttcttggggtgaggtatcttaccctggtgtagaaaaaaccatgaaggaagctgatgcagtaattgcattagctcctgttttcaatgattactctaccactggttggactgatattccagaccccaaaaaattagttttagcagaacctcgctctgtagttgtgaatggtgttagatttcccagtgtacatctcaaagattatttaactcgtttagctcaaaaagtgagtaaaaagactggcgcactcgatttctttaaatctttaaatgctggtgaattaaagaaagcagctcctgctgatcccagtgctcctttagtgaatgccgaaatcgcaagacaagttgaagccttgttaactcctaacactaccgttattgccgagactggtgatagttggttcaatgctcaacgcatgaaattacccaatggtgctcgtgttgagtatgaaatgcaatggggtcacattggatggtctgttcctgctgcatttggatatgcagttggagcacctgagcgtagaaacattttaatggtaggtgatggttctttccaactcactgctcaagaagttgcacaaatggtacgtttaaaattgcctgttattatctttctcattaacaactatggttacaccattgaagttatgattcatgatggtccttataataacattaagaattgggattacgcaggtttaatggaggtatttaacggtaatggtggatacgacagtggagcaggtaaaggattaaaagctaaaacaggaggtgagttagctgaagcaattaaagtagctttagccaatacagatggtcctaccttaatcgaatgtttcattggacgtgaagattgtactgaagagttagttaaatggggaaagcgtgttgccgctgcaaattctcgtaaacctgtaaacaaactcttgtagttaggatccagcaaggtttcatcccgaccccctcagggtcgggatttttttattgtgagctcaactttagatattcgtagttggcaatgtcgtaaatgcggaacaatacatggaaaacatatagatttgtaatgagaaaaagtgtaaacaaatattaagaaaaagatcagaaaaatttaacaacacgtaataaaaaaatgcgtcactacgggttataaatttacatgaaaggttaaaacacttttctgagacgattttgataaaaaagttgtcaaaaaattaagtttctttacaaatgcttaacaaaaacttggttttaagcacaaaataagagagactaatttgcagaagttttacaaggaaatcttgaagaaaaagatctaagtaaaacgactctgtttaaccaaaatttaacaaatttaacaaaacaaactaaatctattaggagattaactacatatgcctatgatcaaagccttcgcagttcatgagtctgatggagatttacagccttttgaatatgatcctggtgcattattatctgatcaagttgagatcgaagttaaatattgtggaatttgtcattctgatttatctatgatctctaatgaatggggtatgacccaataccctttagtacctggacatgaggtagtaggtgcaatcgccaaagtaggtgaaaatgttaaaaatttatctgttggtcaaattgtaggattaggttggcacgcaggttattgtaacgaatgtcctcaatgtactactggtgatcaaaatttatgtgctactgctcaaggaactattgtaggacatcatggaggtttcgctgaaaaagttcgcgctgctgcaaattctgtagttcccatccctgaaggaatcgatttagaagctgctggacctttattttgtggaggtatcaccgtttttaatcctttagtacaatatggaatccaacccactgcaaaagttgctgtaattggaattggaggtttaggtcacatggctgttcaattcttaaacgcttggggttgtgaagttaccgcttttaccagttctgaagcaaaaatcactgaggctttagaattaggtgctcatcacactttaaacagtcgtgaccctgaagccatcgcagccgctgctggacagtttgatttaatcatttctaccgttaacgttaaattagattggaatgcctatttaagtactttaaaacctcacggtcgtttacacttcgtaggtgctactttagatcccttagacattaacgtttttgctttaatcatgcagcaacgttctatctctggtagtcctgttggatctcctgcaaccatcgcaaaaatgttagaatttgcaaaattacataaaattcaacctaaaattgaaacctttaaatttgaagatgttaaccaggctattgcacgtttaaaaagtggtgaagcccactatcgtattgtattatgtagataactagatctacttctaaactgaaacaaatttgagggtaggcttcattgtctgcccttatttttttatttaggaaaagtgaacagactaaagagtgttggctctattgctttgagtatgtaaattaggcgttgctgaattaaggtatgatttttgacccctgcaggatcatcttgctgaaaaactcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgccctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttgaatatttttcgtcagatacgcaaaccttacaaacataattaacaactgaaactattgatatgtctaggttttagctctatcacaggttggatctg

SEQ ID NO: 102 - DNA, 13064 bp, Cyanobacterium sp. ABICyano1
tcgacaattaataacttcttcctgtacgggcgaatggccatttgctcctaactaactccgtactgctttgcggaacgagcgtagcgaactctccgaattactaagccttcatccctgatagatgcaaaaaacgaattaaaattatgtgtaaaaagaaaatgtgtctttatttagtagtcaaagttacaaaatattaagaatcaaattaataatgtattgggcagttaagtatataagtctttaaatatttatttgtattcaatatattaaggaggatcagccttatgaattcttataccgtgggtacttatttagccgaacgcttagtgcaaattggtttaaaacatcattttgccgtggctggggactataatttagtgttattggataacttattattaaataaaaacatggaacaagtgtattgttgtaatgaattaaattgtggtttttctgctgaaggttatgctagagctaaaggtgcagctgctgctgttgttacttattctgtgggtgctttatctgcttttgatgctattggtggtgcttatgccgaaaatttacccgtgattttaatttctggtgcccctaataataatgatcatgccgctggacatgttttacatcatgccttaggtaaaaccgattatcattatcaattagaaatggccaaaaatattactgctgctgccgaagctatttatactcctgaagaagcccctgccaaaattgatcatgtgattaaaaccgccttacgcgaaaaaaaacccgtgtatttagaaattgcctgtaatattgcttctatgccttgtgctgctcctgggcctgcttctgctttatttaatgatgaagcctctgatgaagctagtttaaatgctgccgtggaagaaaccttaaaatttattgccaatcgcgataaagttgccgtgttagttggttctaaattaagagctgctggtgctgaagaagctgctgttaaatttgctgatgctttaggtggtgcagttgctactatggctgctgccaaatctttttttcccgaagaaaatccccattatattggaactagttggggagaagtttcttatcctggtgtggaaaaaactatgaaagaagccgacgctgttattgctttagcccctgtgtttaatgattattctaccactggttggactgatattcccgatcccaaaaaattagttttagccgaacctcgttctgttgttgttaatggtgttcgctttccctctgtgcatttaaaagattatttaacccgcttagcccaaaaagtttctaaaaaaactggtgccttagatttttttaaatctttaaatgcgggtgaattaaaaaaagctgctcctgctgatccttctgctcctttagttaatgctgaaattgcccgtcaagttgaagccttattaacccctaatactaccgttattgccgaaactggtgattcttggtttaatgcccaacgcatgaaattacctaatggtgcccgtgttgaatatgaaatgcaatggggtcatattggttggtctgtacctgctgcttttggttatgctgttggtgctcctgaacgtcgtaatattttaatggtgggtgatggttcttttcaattaactgcccaagaagttgcccaaatggttcgcttaaaattacccgttattatttttttaataaataattatggttataccattgaagtgatgattcatgatgggccatataataatattaaaaattgggattatgcgggtttaatggaagtgtttaatggtaatggtggttatgattctggtgctggtaaaggtttaaaagccaaaactggtggtgaattagctgaagctattaaagttgccttagccaatactgatgggccaaccttaattgaatgttttattggtcgcgaagattgtaccgaagaattagttaaatggggtaaacgtgttgctgctgctaattctcgcaaacccgtgaataaattattgtaaggatccagcaagtttcatcccgaccccctcagggtcgggatttttttattgtgagctcaactttagatattcgtagttggcaatgtcgtaaatgcggaacaatacatggaaaacatatagatttgtaatgagaaaaagtgtaaacaaatattaagaaaaagatcagaaaaatttaacaacacgtaataaaaaaatgcgtcactacgggttataaatttacatgaaaggttaaaacacttttctgagacgattttgataaaaaagttgtcaaaaaattaagtttctttacaaatgcttaacaaaaacttggttttaagcacaaaataagagagactaatttgcagaagttttacaaggaaatcttgaagaaaaagatctaagtaaaacgactctgtttaaccaaaatttaacaaatttaacaaaacaaactaaatctattaggagattaactacatatgatccgtgcttatgcagctcaggagaaaggaggtaaattagaaccctttgattatgaccctggtattttagcagacgaagacgttgagattgctgttgagtactgtggaatttgtcattccgatttatctatgctcgataatgactggggtttaactacttaccctttcgttcccggtcacgaggttgtaggaaccattgctgcattaggagccaaagtaaaagaactcaaattgggtcagcgtgtaggattaggatggttcagtcgttcttgttctacctgtgagacttgtatgtctggtgatcaaaatttatgtgcaaccgctgaaggtactattgtaggaagacatggtggatttgctgagcgtgttcgtgctcaccattcttggttagtacctttacccgatcaattagacgcagctaaagccggtcctttattttgtggtggtatcactgtatttaatcctatcgttcagttcaacatcaaacctaccgcacgtgtaggtgttatcggaatcggaggtttaggtcacattgctctcaaatttttaaaagcatggggttgtgaggtaactgcctttagttcttctcctgacaaagaaaccgaagctaaagagttaggtgcaacccattttattaactctcgtgatcctgaagcattacaaagtgttcagaactatttcgactttattattagtactgtaaatgtaaacttagattggggattatacattgcttgtttacgtcctaaaggaagattacacattgtaggtgcagtattagagcctatggctacttatgcattccctttaatcatgggacagaaatctattagtggatctcccttaggatctcctagtactgtttctaaaatgatcgagtttgcttcccgtcatggtatcgagcccgttaccgaaacttaccccatttctcgtgttaacgaagcaatggagaaattaagaactggtcagcccaaatacagattggttctccaaattaaataactagatctacttctaaactgaaacaaatttgagggtaggcttcattgtctgcccttatttttttatttaggaaaagtgaacagactaaagagtgttggctctattgctttgagtatgtaaattaggcgttgctgaattaaggtatgatttttgacccctgcaggatcatcttgctgaaaaactcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgccctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttgaatatttttcgtcagatacgcaaaccttacaaacataattaacaactgaaactattgatatgtctaggttttagctctatcacaggttggatctg

SEQ ID NO: 103 - DNA, 13134 bp, Cyanobacterium sp. ABICyano1
tcgactggtcaagttactatatgtttagaaacaacaaaaaaagaagtcattataaaaataattgatacaggaattggcattaataaagaagaacaaaaattaatttttaatcgtttttatcgaatcaataaagcaagaaatagagagaaaggcagttgcggattaggtttagctattgcaaatgcgatcgcgcttaatcatggtggtagaataattttagaaagtcaagaaaatcaaggcagtatttttaccgtttatttaccgaaaatcatttcatcctaatttcatattcttttgacagaatcaaaggtaaagataaaaagagagaaacagtcatgaattcttacactgttggaacctatttagcagaacgtttagttcaaattggtctcaaacaccattttgcagtagctggtgattataatttagttttattggataacttattgttaaataagaatatggaacaagtgtattgttgtaatgaattaaactgtggtttttctgctgagggatatgctcgtgcaaaaggtgctgccgcagcagttgttacttattctgttggagcattaagtgcttttgacgctattggaggtgcttatgcagaaaatttacctgtaatcttaatctctggtgcacccaataacaacgatcacgctgctggtcatgtattgcatcatgctttaggtaaaaccgattatcattaccaattagaaatggcaaaaaatattaccgctgccgcagaagctatttatactcccgaagaagcacctgctaagatcgatcacgtaattaaaaccgctctccgtgagaaaaaacccgtatatttagaaatcgcttgcaatatcgcttctatgccttgtgcagctcctggacctgctagtgctttatttaacgatgaagcatctgatgaggctagtttaaatgccgctgttgaagaaactttgaaatttattgctaatcgtgataaagtagctgttttagttggttctaaactccgtgccgctggtgcagaagaagcggctgtaaaattcgcagatgccttaggaggtgctgttgccacaatggcagccgctaaaagttttttccccgaagaaaatcctcattacattggtacttcttggggtgaggtatcttaccctggtgtagaaaaaaccatgaaggaagctgatgcagtaattgcattagctcctgttttcaatgattactctaccactggttggactgatattccagaccccaaaaaattagttttagcagaacctcgctctgtagttgtgaatggtgttagatttcccagtgtacatctcaaagattatttaactcgtttagctcaaaaagtgagtaaaaagactggcgcactcgatttctttaaatctttaaatgctggtgaattaaagaaagcagctcctgctgatcccagtgctcctttagtgaatgccgaaatcgcaagacaagttgaagccttgttaactcctaacactaccgttattgccgagactggtgatagttggttcaatgctcaacgcatgaaattacccaatggtgctcgtgttgagtatgaaatgcaatggggtcacattggatggtctgttcctgctgcatttggatatgcagttggagcacctgagcgtagaaacattttaatggtaggtgatggttctttccaactcactgctcaagaagttgcacaaatggtacgtttaaaattgcctgttattatctttctcattaacaactatggttacaccattgaagttatgattcatgatggtccttataataacattaagaattgggattacgcaggtttaatggaggtatttaacggtaatggtggatacgacagtggagcaggtaaaggattaaaagctaaaacaggaggtgagttagctgaagcaattaaagtagctttagccaatacagatggtcctaccttaatcgaatgtttcattggacgtgaagattgtactgaagagttagttaaatggggaaagcgtgttgccgctgcaaattctcgtaaacctgtaaacaaactcttgtagttaggatccagcaaggtttcatcccgaccccctcagggtcgggatttttttattgtgagctcaactttagatattcgtagttggcaatgtcgtaaatgcggaacaatacatggaaaacatatagatttgtaatgagaaaaagtgtaaacaaatattaagaaaaagatcagaaaaatttaacaacacgtaataaaaaaatgcgtcactacgggttataaatttacatgaaaggttaaaacacttttctgagacgattttgataaaaaagttgtcaaaaaattaagtttctttacaaatgcttaacaaaaacttggttttaagcacaaaataagagagactaatttgcagaagttttacaaggaaatcttgaagaaaaagatctaagtaaaacgactctgtttaaccaaaatttaacaaatttaacaaaacaaactaaatctattaggagattaactacatatgagtgaaactaaatttaaagcctatgccgtaatgaatcctggtgaaaaattacaaccctgggaatatgaacctgctcctttacaggtagatgaaattgaagtaagagttactcacaatggtttatgtcacactgacttacacatgagagataatgactggaatgttagtgagttccccttagtagcaggtcatgaagttgttggtgaagtaaccgctgttggtgaaaaagtaaccagtcgtaaaaaaggtgatagagttggtgtaggttggattcgtaattcttgtcgcgcttgtgaccattgtttacaaggagaagagaacatttgtagagagggttatactggtttaattgttggtcatcacggtggatttgctgatcgtgtacgtgtacctgctgacttcacttataaaattcctgatgctttagatagtgcatctgctgctcctttattatgtgccggtattaccgtttacactcctttaagaacctacattaaacatcccggtatgaaagtaggtgttatgggtattggaggattaggacatttagctattaaatttgctcgtgcaatgggagcagaagttactgcctttagtaccagtcctaataaagaagcccaagccaaagaatttggtgctcatcatttccaacaatggggtactgctgaagaaatgaaagctgttgccggtaattttgatttagttttatctaccatctctgctgaaactgactgggatgctgccttctctttattagcaaataacggtgttttatgtttcgtaggtattcccgttagttctttaaatgttcctttaattcctttaattttcggacaaaaatctgttgtaggttctgtagttggaggaagaagattcatggcagaaatgttagagttcgccgctgtaaatcagattaaacctatgatcgaaactatgcccttatctcaagtaaatgaagctatggataaagttgccgccaataaagccagatatagaattgtattattatctgaataactagatctacttctaaactgaaacaaatttgagggtaggcttcattgtctgcccttatttttttatttaggaaaagtgaacagactaaagagtgttggctctattgctttgagtatgtaaattaggcgttgctgaattaaggtatgatttttgacccctgcaggatcatcttgctgaaaaactcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgccctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttgaatatttttcgtcagatacgcaaaccttacaaacataattaacaactgaaactattgatatgtctaggttttagctctatcacaggttggatctg

SEQ ID NO: 104 - DNA, 13122 bp, Cyanobacterium sp. ABICyano1
tcgactggtcaagttactatatgtttagaaacaacaaaaaaagaagtcattataaaaataattgatacaggaattggcattaataaagaagaacaaaaattaatttttaatcgtttttatcgaatcaataaagcaagaaatagagagaaaggcagttgcggattaggtttagctattgcaaatgcgatcgcgcttaatcatggtggtagaataattttagaaagtcaagaaaatcaaggcagtatttttaccgtttatttaccgaaaatcatttcatcctaatttcatattcttttgacagaatcaaaggtaaagataaaaagagagaaacagtcatgaattcttacactgttggaacctatttagcagaacgtttagttcaaattggtctcaaacaccattttgcagtagctggtgattataatttagttttattggataacttattgttaaataagaatatggaacaagtgtattgttgtaatgaattaaactgtggtttttctgctgagggatatgctcgtgcaaaaggtgctgccgcagcagttgttacttattctgttggagcattaagtgcttttgacgctattggaggtgcttatgcagaaaatttacctgtaatcttaatctctggtgcacccaataacaacgatcacgctgctggtcatgtattgcatcatgctttaggtaaaaccgattatcattaccaattagaaatggcaaaaaatattaccgctgccgcagaagctatttatactcccgaagaagcacctgctaagatcgatcacgtaattaaaaccgctctccgtgagaaaaaacccgtatatttagaaatcgcttgcaatatcgcttctatgccttgtgcagctcctggacctgctagtgctttatttaacgatgaagcatctgatgaggctagtttaaatgccgctgttgaagaaactttgaaatttattgctaatcgtgataaagtagctgttttagttggttctaaactccgtgccgctggtgcagaagaagcggctgtaaaattcgcagatgccttaggaggtgctgttgccacaatggcagccgctaaaagttttttccccgaagaaaatcctcattacattggtacttcttggggtgaggtatcttaccctggtgtagaaaaaaccatgaaggaagctgatgcagtaattgcattagctcctgttttcaatgattactctaccactggttggactgatattccagaccccaaaaaattagttttagcagaacctcgctctgtagttgtgaatggtgttagatttcccagtgtacatctcaaagattatttaactcgtttagctcaaaaagtgagtaaaaagactggcgcactcgatttctttaaatctttaaatgctggtgaattaaagaaagcagctcctgctgatcccagtgctcctttagtgaatgccgaaatcgcaagacaagttgaagccttgttaactcctaacactaccgttattgccgagactggtgatagttggttcaatgctcaacgcatgaaattacccaatggtgctcgtgttgagtatgaaatgcaatggggtcacattggatggtctgttcctgctgcatttggatatgcagttggagcacctgagcgtagaaacattttaatggtaggtgatggttctttccaactcactgctcaagaagttgcacaaatggtacgtttaaaattgcctgttattatctttctcattaacaactatggttacaccattgaagttatgattcatgatggtccttataataacattaagaattgggattacgcaggtttaatggaggtatttaacggtaatggtggatacgacagtggagcaggtaaaggattaaaagctaaaacaggaggtgagttagctgaagcaattaaagtagctttagccaatacagatggtcctaccttaatcgaatgtttcattggacgtgaagattgtactgaagagttagttaaatggggaaagcgtgttgccgctgcaaattctcgtaaacctgtaaacaaactcttgtagttaggatccagcaaggtttcatcccgaccccctcagggtcgggatttttttattgtgagctcaactttagatattcgtagttggcaatgtcgtaaatgcggaacaatacatggaaaacatatagatttgtaatgagaaaaagtgtaaacaaatattaagaaaaagatcagaaaaatttaacaacacgtaataaaaaaatgcgtcactacgggttataaatttacatgaaaggttaaaacacttttctgagacgattttgataaaaaagttgtcaaaaaattaagtttctttacaaatgcttaacaaaaacttggttttaagcacaaaataagagagactaatttgcagaagttttacaaggaaatcttgaagaaaaagatctaagtaaaacgactctgtttaaccaaaatttaacaaatttaacaaaacaaactaaatctattaggagattaactacatatgcctatgatcaaagccttcgcagttcatgagtctgatggagatttacagccttttgaatatgatcctggtgcattattatctgatcaagttgagatcgaagttaaatattgtggaatttgtcattctgatttatctatgatctctaatgaatggggtatgacccaataccctttagtacctggacatgaggtagtaggtgcaatcgccaaagtaggtgaaaatgttaaaaatttatctgttggtcaaattgtaggattaggttggcacgcaggttattgtaacgaatgtcctcaatgtactactggtgatcaaaatttatgtgctactgctcaaggaactattgtaggacatcatggaggtttcgctgaaaaagttcgcgctgctgcaaattctgtagttcccatccctgaaggaatcgatttagaagctgctggacctttattttgtggaggtatcaccgtttttaatcctttagtacaatatggaatccaacccactgcaaaagttgctgtaattggaattggaggtttaggtcacatggctgttcaattcttaaacgcttggggttgtgaagttaccgcttttaccagttctgaagcaaaaatcactgaggctttagaattaggtgctcatcacactttaaacagtcgtgaccctgaagccatcgcagccgctgctggacagtttgatttaatcatttctaccgttaacgttaaattagattggaatgcctatttaagtactttaaaacctcacggtcgtttacacttcgtaggtgctactttagatcccttagacattaacgtttttgctttaatcatgcagcaacgttctatctctggtagtcctgttggatctcctgcaaccatcgcaaaaatgttagaatttgcaaaattacataaaattcaacctaaaattgaaacctttaaatttgaagatgttaaccaggctattgcacgtttaaaaagtggtgaagcccactatcgtattgtattatgtagataactagatctacttctaaactgaaacaaatttgagggtaggcttcattgtctgcccttatttttttatttaggaaaagtgaacagactaaagagtgttggctctattgctttgagtatgtaaattaggcgttgctgaattaaggtatgatttttgacccctgcaggatcatcttgctgaaaaactcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgccctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttgaatatttttcgtcagatacgcaaaccttacaaacataattaacaactgaaactattgatatgtctaggttttagctctatcacaggttggatctg

SEQ ID NO: 105 - DNA, 13115 bp, Cyanobacterium sp. ABICyano1
tcgactggtcaagttactatatgtttagaaacaacaaaaaaagaagtcattataaaaataattgatacaggaattggcattaataaagaagaacaaaaattaatttttaatcgtttttatcgaatcaataaagcaagaaatagagagaaaggcagttgcggattaggtttagctattgcaaatgcgatcgcgcttaatcatggtggtagaataattttagaaagtcaagaaaatcaaggcagtatttttaccgtttatttaccgaaaatcatttcatcctaatttcatattcttttgacagaatcaaaggtaaagataaaaagagagaaacagtcatgaattcttataccgtgggtacttatttagccgaacgcttagtgcaaattggtttaaaacatcattttgccgtggctggggactataatttagtgttattggataacttattattaaataaaaacatggaacaagtgtattgttgtaatgaattaaattgtggtttttctgctgaaggttatgctagagctaaaggtgcagctgctgctgttgttacttattctgtgggtgctttatctgcttttgatgctattggtggtgcttatgccgaaaatttacccgtgattttaatttctggtgcccctaataataatgatcatgccgctggacatgttttacatcatgccttaggtaaaaccgattatcattatcaattagaaatggccaaaaatattactgctgctgccgaagctatttatactcctgaagaagcccctgccaaaattgatcatgtgattaaaaccgccttacgcgaaaaaaaacccgtgtatttagaaattgcctgtaatattgcttctatgccttgtgctgctcctgggcctgcttctgctttatttaatgatgaagcctctgatgaagctagtttaaatgctgccgtggaagaaaccttaaaatttattgccaatcgcgataaagttgccgtgttagttggttctaaattaagagctgctggtgctgaagaagctgctgttaaatttgctgatgctttaggtggtgcagttgctactatggctgctgccaaatctttttttcccgaagaaaatccccattatattggaactagttggggagaagtttcttatcctggtgtggaaaaaactatgaaagaagccgacgctgttattgctttagcccctgtgtttaatgattattctaccactggttggactgatattcccgatcccaaaaaattagttttagccgaacctcgttctgttgttgttaatggtgttcgctttccctctgtgcatttaaaagattatttaacccgcttagcccaaaaagtttctaaaaaaactggtgccttagatttttttaaatctttaaatgcgggtgaattaaaaaaagctgctcctgctgatccttctgctcctttagttaatgctgaaattgcccgtcaagttgaagccttattaacccctaatactaccgttattgccgaaactggtgattcttggtttaatgcccaacgcatgaaattacctaatggtgcccgtgttgaatatgaaatgcaatggggtcatattggttggtctgtacctgctgcttttggttatgctgttggtgctcctgaacgtcgtaatattttaatggtgggtgatggttcttttcaattaactgcccaagaagttgcccaaatggttcgcttaaaattacccgttattatttttttaataaataattatggttataccattgaagtgatgattcatgatgggccatataataatattaaaaattgggattatgcgggtttaatggaagtgtttaatggtaatggtggttatgattctggtgctggtaaaggtttaaaagccaaaactggtggtgaattagctgaagctattaaagttgccttagccaatactgatgggccaaccttaattgaatgttttattggtcgcgaagattgtaccgaagaattagttaaatggggtaaacgtgttgctgctgctaattctcgcaaacccgtgaataaattattgtaaggatccagcaagtttcatcccgaccccctcagggtcgggatttttttattgtgagctcaactttagatattcgtagttggcaatgtcgtaaatgcggaacaatacatggaaaacatatagatttgtaatgagaaaaagtgtaaacaaatattaagaaaaagatcagaaaaatttaacaacacgtaataaaaaaatgcgtcactacgggttataaatttacatgaaaggttaaaacacttttctgagacgattttgataaaaaagttgtcaaaaaattaagtttctttacaaatgcttaacaaaaacttggttttaagcacaaaataagagagactaatttgcagaagttttacaaggaaatcttgaagaaaaagatctaagtaaaacgactctgtttaaccaaaatttaacaaatttaacaaaacaaactaaatctattaggagattaactacatatgatccgtgcttatgcagctcaggagaaaggaggtaaattagaaccctttgattatgaccctggtattttagcagacgaagacgttgagattgctgttgagtactgtggaatttgtcattccgatttatctatgctcgataatgactggggtttaactacttaccctttcgttcccggtcacgaggttgtaggaaccattgctgcattaggagccaaagtaaaagaactcaaattgggtcagcgtgtaggattaggatggttcagtcgttcttgttctacctgtgagacttgtatgtctggtgatcaaaatttatgtgcaaccgctgaaggtactattgtaggaagacatggtggatttgctgagcgtgttcgtgctcaccattcttggttagtacctttacccgatcaattagacgcagctaaagccggtcctttattttgtggtggtatcactgtatttaatcctatcgttcagttcaacatcaaacctaccgcacgtgtaggtgttatcggaatcggaggtttaggtcacattgctctcaaatttttaaaagcatggggttgtgaggtaactgcctttagttcttctcctgacaaagaaaccgaagctaaagagttaggtgcaacccattttattaactctcgtgatcctgaagcattacaaagtgttcagaactatttcgactttattattagtactgtaaatgtaaacttagattggggattatacattgcttgtttacgtcctaaaggaagattacacattgtaggtgcagtattagagcctatggctacttatgcattccctttaatcatgggacagaaatctattagtggatctcccttaggatctcctagtactgtttctaaaatgatcgagtttgcttcccgtcatggtatcgagcccgttaccgaaacttaccccatttctcgtgttaacgaagcaatggagaaattaagaactggtcagcccaaatacagattggttctccaaattaaataactagatctacttctaaactgaaacaaatttgagggtaggcttcattgtctgcccttatttttttatttaggaaaagtgaacagactaaagagtgttggctctattgctttgagtatgtaaattaggcgttgctgaattaaggtatgatttttgacccctgcaggatcatcttgctgaaaaactcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgccctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttgaatatttttcgtcagatacgcaaaccttacaaacataattaacaactgaaactattgatatgtctaggttttagctctatcacaggttggatctg

SEQ ID NO: 106 - DNA, 14725 bp, Cyanobacterium sp. ABICyano1
tcgacaattaataacttcttcctgtacgggcgaatggccatttgctcctaactaactccgtactgctttgcggaacgagcgtagcgaactctccgaattactaagccttcatccctgatagatgcaaaaaacgaattaaaattatgtgtaaaaagaaaatgtgtctttatttagtagtcaaagttacaaaatattaagaatcaaattaataatgtattgggcagttaagtatataagtctttaaatatttatttgtattcaatatattaaccgaggacaaattatgaattcttacactgttggaacctatttagcagaacgtttagttcaaattggtctcaaacaccattttgcagtagctggtgattataatttagttttattggataacttattgttaaataagaatatggaacaagtgtattgttgtaatgaattaaactgtggtttttctgctgagggatatgctcgtgcaaaaggtgctgccgcagcagttgttacttattctgttggagcattaagtgcttttgacgctattggaggtgcttatgcagaaaatttacctgtaatcttaatctctggtgcacccaataacaacgatcacgctgctggtcatgtattgcatcatgctttaggtaaaaccgattatcattaccaattagaaatggcaaaaaatattaccgctgccgcagaagctatttatactcccgaagaagcacctgctaagatcgatcacgtaattaaaaccgctctccgtgagaaaaaacccgtatatttagaaatcgcttgcaatatcgcttctatgccttgtgcagctcctggacctgctagtgctttatttaacgatgaagcatctgatgaggctagtttaaatgccgctgttgaagaaactttgaaatttattgctaatcgtgataaagtagctgttttagttggttctaaactccgtgccgctggtgcagaagaagcggctgtaaaattcgcagatgccttaggaggtgctgttgccacaatggcagccgctaaaagttttttccccgaagaaaatcctcattacattggtacttcttggggtgaggtatcttaccctggtgtagaaaaaaccatgaaggaagctgatgcagtaattgcattagctcctgttttcaatgattactctaccactggttggactgatattccagaccccaaaaaattagttttagcagaacctcgctctgtagttgtgaatggtgttagatttcccagtgtacatctcaaagattatttaactcgtttagctcaaaaagtgagtaaaaagactggcgcactcgatttctttaaatctttaaatgctggtgaattaaagaaagcagctcctgctgatcccagtgctcctttagtgaatgccgaaatcgcaagacaagttgaagccttgttaactcctaacactaccgttattgccgagactggtgatagttggttcaatgctcaacgcatgaaattacccaatggtgctcgtgttgagtatgaaatgcaatggggtcacattggatggtctgttcctgctgcatttggatatgcagttggagcacctgagcgtagaaacattttaatggtaggtgatggttctttccaactcactgctcaagaagttgcacaaatggtacgtttaaaattgcctgttattatctttctcattaacaactatggttacaccattgaagttatgattcatgatggtccttataataacattaagaattgggattacgcaggtttaatggaggtatttaacggtaatggtggatacgacagtggagcaggtaaaggattaaaagctaaaacaggaggtgagttagctgaagcaattaaagtagctttagccaatacagatggtcctaccttaatcgaatgtttcattggacgtgaagattgtactgaagagttagttaaatggggaaagcgtgttgccgctgcaaattctcgtaaacctgtaaacaaactcttgtagttaggatccagcaaggtttcatcccgaccccctcagggtcgggatttttttattgtgagctctgacataagtaaaggcatcccctgcgtgatataattaccttcagtttaaggaggtatacacatatgattaaagcctacgctgccctggaagccaacggaaaactccaaccctttgaatacgaccccggtgccctgggtgctaatgaggtggagattgaggtgcagtattgtggggtgtgccacagtgatttgtccatgattaataacgaatggggcatttccaattaccccctagtgccgggtcatgaggtggtgggtactgtggccgccatgggcgaaggggtgaaccatgttgaggtgggggatttagtggggctgggttggcattcgggctactgcatgacctgccatagttgtttatctggctaccacaacctttgtgccacggcggaatcgaccattgtgggccactacggtggctttggcgatcgggttcgggccaagggagtcagcgtggtgaaattacctaaaggcattgacctagccagtgccgggccccttttctgtggaggaattaccgttttcagtcctatggtggaactgagtttaaagcccactgcaaaagtggcagtgatcggcattgggggcttgggccatttagcggtgcaatttctccgggcctggggctgtgaagtgactgcctttacctccagtgccaggaagcaaacggaagtgttggaattgggcgctcaccacatactagattccaccaatccagaggcgatcgccagtgcggaaggcaaatttgactatattatctccactgtgaacctgaagcttgactggaacttatacatcagcaccctggcgccccagggacatttccactttgttggggtggtgttggagcctttggatctaaatctttttccccttttgatgggacaacgctccgtttctgcctccccagtgggtagtcccgccaccattgccaccatgttggactttgctgtgcgccatgacattaaacccgtggtggaacaatttagctttgatcagatcaacgaggcgatcgcccatctagaaagcggcaaagcccattatcgggtagtgctcagccatagtaaaaattagctctgcaaaggttgcttctagatctgtggaacgcccggttgccaccgggcgttttttattcctgcaggaatatctcatccttagcttctacttataccttcagcatagttaaaaatcatccctttattgatggtaataaaagaacaggttttattagtggagtaacctttttaatgctcaatggttctcactttactgcttctgaagtggaagtagtacatatcatccaaaccttagctagtggcagaattaccgaggaagaattacaacaatggttcgtaaggaaaagtaagcagatgaataattaaagcatcatttcatcctcatttcatattctcctgtcaccatggtatggaagattaggtaaaaatgaggaaaaagtttattatgaattcttataccgtgggtacttatttagccgaacgcttagtgcaaattggtttaaaacatcattttgccgtggctggggactataatttagtgttattggataacttattattaaataaaaacatggaacaagtgtattgttgtaatgaattaaattgtggtttttctgctgaaggttatgctagagctaaaggtgcagctgctgctgttgttacttattctgtgggtgctttatctgcttttgatgctattggtggtgcttatgccgaaaatttacccgtgattttaatttctggtgcccctaataataatgatcatgccgctggacatgttttacatcatgccttaggtaaaaccgattatcattatcaattagaaatggccaaaaatattactgctgctgccgaagctatttatactcctgaagaagcccctgccaaaattgatcatgtgattaaaaccgccttacgcgaaaaaaaacccgtgtatttagaaattgcctgtaatattgcttctatgccttgtgctgctcctgggcctgcttctgctttatttaatgatgaagcctctgatgaagctagtttaaatgctgccgtggaagaaaccttaaaatttattgccaatcgcgataaagttgccgtgttagttggttctaaattaagagctgctggtgctgaagaagctgctgttaaatttgctgatgctttaggtggtgcagttgctactatggctgctgccaaatctttttttcccgaagaaaatccccattatattggaactagttggggagaagtttcttatcctggtgtggaaaaaactatgaaagaagccgacgctgttattgctttagcccctgtgtttaatgattattctaccactggttggactgatattcccgatcccaaaaaattagttttagccgaacctcgttctgttgttgttaatggtgttcgctttccctctgtgcatttaaaagattatttaacccgcttagcccaaaaagtttctaaaaaaactggtgccttagatttttttaaatctttaaatgcgggtgaattaaaaaaagctgctcctgctgatccttctgctcctttagttaatgctgaaattgcccgtcaagttgaagccttattaacccctaatactaccgttattgccgaaactggtgattcttggtttaatgcccaacgcatgaaattacctaatggtgcccgtgttgaatatgaaatgcaatggggtcatattggttggtctgtacctgctgcttttggttatgctgttggtgctcctgaacgtcgtaatattttaatggtgggtgatggttcttttcaattaactgcccaagaagttgcccaaatggttcgcttaaaattacccgttattatttttttaataaataattatggttataccattgaagtgatgattcatgatgggccatataataatattaaaaattgggattatgcgggtttaatggaagtgtttaatggtaatggtggttatgattctggtgctggtaaaggtttaaaagccaaaactggtggtgaattagctgaagctattaaagttgccttagccaatactgatgggccaaccttaattgaatgttttattggtcgcgaagattgtaccgaagaattagttaaatggggtaaacgtgttgctgctgctaattctcgcaaacccgtgaataaattattgtaatttttggggatcaattcgagctcagcaagtttcatcccgaccccctcagggtcgggatttttttattgtactcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgccctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttgaatatttttcgtcagatacgcaaaccttacaaacataattaacaactgaaactattgatatgtctaggttttagctctatcacaggttggatctg

SEQ ID NO: 107 - DNA, 9185 bp, Cyanobacterium sp. ABICyano1
tcgacaattaataacttcttcctgtacgggcgaatggccatttgctcctaactaactccgtactgctttgcggaacgagcgtagcgaactctccgaattactaagccttcatccctgatagatgcaaaaaacgaattaaaattatgtgtaaaaagaaaatgtgtctttatttagtagtcaaagttacaaaatattaagaatcaaattaataatgtattgggcagttaagtatataagtctttaaatatttatttgtattcaatatattaaccgaggacaaattatgaattcttataccgtgggtacttatttagccgaacgcttagtgcaaattggtttaaaacatcattttgccgtggctggggactataatttagtgttattggataacttattattaaataaaaacatggaacaagtgtattgttgtaatgaattaaattgtggtttttctgctgaaggttatgctagagctaaaggtgcagctgctgctgttgttacttattctgtgggtgctttatctgcttttgatgctattggtggtgcttatgccgaaaatttacccgtgattttaatttctggtgcccctaataataatgatcatgccgctggacatgttttacatcatgccttaggtaaaaccgattatcattatcaattagaaatggccaaaaatattactgctgctgccgaagctatttatactcctgaagaagcccctgccaaaattgatcatgtgattaaaaccgccttacgcgaaaaaaaacccgtgtatttagaaattgcctgtaatattgcttctatgccttgtgctgctcctgggcctgcttctgctttatttaatgatgaagcctctgatgaagctagtttaaatgctgccgtggaagaaaccttaaaatttattgccaatcgcgataaagttgccgtgttagttggttctaaattaagagctgctggtgctgaagaagctgctgttaaatttgctgatgctttaggtggtgcagttgctactatggctgctgccaaatctttttttcccgaagaaaatccccattatattggaactagttggggagaagtttcttatcctggtgtggaaaaaactatgaaagaagccgacgctgttattgctttagcccctgtgtttaatgattattctaccactggttggactgatattcccgatcccaaaaaattagttttagccgaacctcgttctgttgttgttaatggtgttcgctttccctctgtgcatttaaaagattatttaacccgcttagcccaaaaagtttctaaaaaaactggtgccttagatttttttaaatctttaaatgcgggtgaattaaaaaaagctgctcctgctgatccttctgctcctttagttaatgctgaaattgcccgtcaagttgaagccttattaacccctaatactaccgttattgccgaaactggtgattcttggtttaatgcccaacgcatgaaattacctaatggtgcccgtgttgaatatgaaatgcaatggggtcatattggttggtctgtacctgctgcttttggttatgctgttggtgctcctgaacgtcgtaatattttaatggtgggtgatggttcttttcaattaactgcccaagaagttgcccaaatggttcgcttaaaattacccgttattatttttttaataaataattatggttataccattgaagtgatgattcatgatgggccatataataatattaaaaattgggattatgcgggtttaatggaagtgtttaatggtaatggtggttatgattctggtgctggtaaaggtttaaaagccaaaactggtggtgaattagctgaagctattaaagttgccttagccaatactgatgggccaaccttaattgaatgttttattggtcgcgaagattgtaccgaagaattagttaaatggggtaaacgtgttgctgctgctaattctcgcaaacccgtgaataaattattgtaaggatccagcaaggtttcatcccgaccccctcagggtcgggatttttttattgtgagctctgacataagtaaaggcatcccctgcgtgatataattaccttcagtttaaggaggtatacacatatgattaaagcctacgctgccctggaagccaacggaaaactccaaccctttgaatacgaccccggtgccctgggtgctaatgaggtggagattgaggtgcagtattgtggggtgtgccacagtgatttgtccatgattaataacgaatggggcatttccaattaccccctagtgccgggtcatgaggtggtgggtactgtggccgccatgggcgaaggggtgaaccatgttgaggtgggggatttagtggggctgggttggcattcgggctactgcatgacctgccatagttgtttatctggctaccacaacctttgtgccacggcggaatcgaccattgtgggccactacggtggctttggcgatcgggttcgggccaagggagtcagcgtggtgaaattacctaaaggcattgacctagccagtgccgggccccttttctgtggaggaattaccgttttcagtcctatggtggaactgagtttaaagcccactgcaaaagtggcagtgatcggcattgggggcttgggccatttagcggtgcaatttctccgggcctggggctgtgaagtgactgcctttacctccagtgccaggaagcaaacggaagtgttggaattgggcgctcaccacatactagattccaccaatccagaggcgatcgccagtgcggaaggcaaatttgactatattatctccactgtgaacctgaagcttgactggaacttatacatcagcaccctggcgccccagggacatttccactttgttggggtggtgttggagcctttggatctaaatctttttccccttttgatgggacaacgctccgtttctgcctccccagtgggtagtcccgccaccattgccaccatgttggactttgctgtgcgccatgacattaaacccgtggtggaacaatttagctttgatcagatcaacgaggcgatcgcccatctagaaagcggcaaagcccattatcgggtagtgctcagccatagtaaaaattagctctgcaaaggttgcttctagatctgtggaacgcccggttgccaccgggcgttttttattcctgcagcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatggtaagatcaagtaacgacgtaacccagcaaggtagtagacctaaaacaaagttgggaggctcaagtatgggtatcattcgcacttgtaggttagggcccgatcaagtgaaatctatgcgagctgctttagatctttttggtagagaatttggtgatgttgcaacttatagtcaacatcaaccagattccgactatttgggaaatcttttacgttctaaaacattcattgcattagcagcatttgatcaggaagctgttgtcggtgcattagccgcttatgttttacccaagtttgaacaacctcgttctgagatctatatctacgatttagcggtatctggcgagcatcgtcgccaagggatagcaacagcgttaatcaatttgttaaagcatgaagctaatgctcttggtgcctatgtgatttacgttcaagcggactatggagatgatcctgccgtagccttgtataccaaacttggaattagagaagaagttatgcactttgatattgatccttctactgctacttaacaattcgttcaagccgagatttaaattacgtacacggcggccgcgaataggaaatctcagttcagagttcggggtgttcactgcactagtcatgaacgggatttttaattcttaattcttaattcttaattatcaattatttaacgtcagttcgggtttgagaatgaaaaaaccctagggataaaggggggtttgcccctagccctttttataaaaaaagaattaaaagctaatcagaaatgaaaaaaataggcagtttaggagagaaaataattgcccagtggttaataaataaaggttattctgttatagaatcaaattggcattgtcgttggggtgaaattgaccttatagtaataaataaaagtttaaaagagattatatttgttgaagttaaaactcgcagtataaaaaattgggatgataatgggctatactctattaataacaaaaaacaagaaaaactctggttaacagctagtttatttttagaaaaaaatcaaatatttactgattggaactgtcgttttgatattgctttattaacttacaaaaaattaactaactttgggacagtattttctgttaacgataattgtttaagaccaaagtttaactatgaaggctatcaatttgaaattgttgattatttggaaaatgctttttaatctgatcttctgcacgtcaaatagtattctacaagacaattcagaatttagaatatattttttggcgttgcttaattatggtatgaaatttactgaaattatgccaaaaattgagacatcaaaatattatcattactgcaagaatgcccatttccccaaccccacctaaatgagaaatcatatacaaaactagtaaagcctatttttttgttacgagattatcccctaactttccattgaggaatcttcaattgtttatcaatgctttttctgctataattgcactcatggtaaggattgaaaacctaaattttaaggtcaattatcttaacttaatcgatagttgtctaagtataactaattgttatagttcatgaagatcaaaatatattgcattttccgcagtattgacagaaacagaagttagtaataaagcaacactatgggtatcagagaaatagttgataattcaagcgatttagaatttagaatcgttagattgatgctaatgccaatagaaatagaattaacttttattaaagaaatagctactattcctttagtctcagctcaaaattagtggactctctactaaattctgtttaggattgccttgttagttaataaattcgctattctcctgattatttttgcgaggagaaaagtcaagtatttacttttttaaaattatgtataaagatataattagtcaccgattaaaactttcattttaagatgatatgagtctaattgtgaacatggaaaagtcgggttttttaaattttacaacttttaggaaactgaaaatataaagtatgaaaaactttatttattcctgaagtcaataggacaaagttcgatgggcaaagggcaaaatgattttgcaagtaccttgacaaaccaaaaattactcgtcttaaaagactgagttttaaacccattgttctttgataaatgataaagaaacgataggataagttaataaaaaatgattttctgggaatcacaagaatttatgaagagatataaaaaaactttcctaagttaagaaaattaagaaaaactaatccatgagactacataaaaacaaggcaaaattttaagattgaactaacattaataattgatttctttaccataattactttgtcttttcataactaattgtgattaaaacagttgaaagtcagactctttttattagctttatatcgttaactaaacattatctgattgtgacaaatttaagcaaaatattttcaaaattatcaacacagaagcgaaaattttgtgaggatatcaatctagaatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctaatgcatattttaccctcgacaaatccaagaccatgcaacatttagggtagaattatttttatactcgtaatgtgattgatgtttataacccatgatttttcccgatttttctgcattttctaaccttgttcatcagggaaattttattcctgtttatcgagaattggtagcggatttagaaacccctgtttctgcttggtataaagtttgtgcagaccagccctatagtttcttgttagagtcagtagaaggtggggaaaatttaggaagatatagctttttaggttgtgatcctgtttggatactagaagcaaggggaaatcagaccaaacaagttcatcgtgatggtaaaatcgaaactttttcaggaaatccctttaacatcctctctcaatgtttagaaactattaaacctgttaaattaccagagttgccccccggtattggcggactatttggttattggggttatgagttaatttcttggattgaaccacgagtcaacgtttatcctgcctctgcggaaagtttacccgatggtatttggatgcaggtagataatttattgatttttgatcaagtaaaaagaaaaatatgggcgatcgcatatgcagatttaagacaggagcatttaagcctagaagaaatctacaatcaggcttgtgacaaaatttctaaattagttttaaaactacaattacctttaccagtatccgcaaaaccccttgaatttaaccccccgccaaaaactcaaaaaaatcatcgcattcaatacaaaagcaacaccagcaaagaggcattttgtgccaatgtggaaaaagctaaagaatacattaaagcaggagatatttttcaagtagtcatttctcagaaattacaatctcattatcaaggtcatccttttgagttgtatcgctccttacgtttgattaacccttccccttatatggcttactataactttcatggatggcagttaatcggctcttctcccgaagtaatggttaaagcagaaaaaactaatgatggtaaaaccaaagccgtagtccgtcccattgcaggaacacgtccaaggggcagaaactatcaagaagaccaatttttagcccaagacttactcaatgatcccaaagaaagggcagaacacgtcatgttagtagatttgggcagaaatgacttaggcagggtctgtgtaaaaggaagcgtggaagtcgatgaattgatggttattgaacgttattcccacgtaatgcacatagtcagtaacgttgtgggagagttagcaggggattactgtgcatgggatttactaaaggcggctttccccgcaggtacggtaagtggagctcctaaaattcgagcaatggaaattattaatgaacttgaacccgaaaggaggggaccttattctggggtttatggttactatgattttgaaggacagttaaatactgctatcacaattagaacgatggttgtggaaaccctttctgggacggaaaatcacttggtatccgttcaagctggagcaggcttagtcgctgactcagatccagacaaggagtatcaagaaactttgaataaagctagaggtttgctagaggcgattagtagcttaagctaagtgaaaattcgtaataaaaaagagcaaatttttgtgactttaaacctgacacctgaaatttatttttgaactccgaacccaaataatgattcaggttgcttaaactcagagaatcattaataattgattcttgttaactcaattgtcatttttaacatgggtgttgaactccgaagctatgtctatctcgatcgattacaacctcaacacgcttcctatataggtacggttgctctaggatttttacctttacccggtgatgcttctttatggattgaaatatcccccggaattgaaataaatcgaattactgatgtggctttgaagtctgctgg

SEQ ID NO: 108 - DNA, 9237 bp, Cyanobacterium sp. ABICyano1
tcgactggtcaagttactatatgtttagaaacaacaaaaaaagaagtcattataaaaataattgatacaggaattggcattaataaagaagaacaaaaattaatttttaatcgtttttatcgaatcaataaagcaagaaatagagagaaaggcagttgcggattaggtttagctattgcaaatgcgatcgcgcttaatcatggtggtagaataattttagaaagtcaagaaaatcaaggcagtatttttaccgtttatttaccgaaaatcatttcatcctaatttcatattcttttgacagaatcaaaggtaaagataaaaagagagaaacagtcatgaattcttataccgtgggtacttatttagccgaacgcttagtgcaaattggtttaaaacatcattttgccgtggctggggactataatttagtgttattggataacttattattaaataaaaacatggaacaagtgtattgttgtaatgaattaaattgtggtttttctgctgaaggttatgctagagctaaaggtgcagctgctgctgttgttacttattctgtgggtgctttatctgcttttgatgctattggtggtgcttatgccgaaaatttacccgtgattttaatttctggtgcccctaataataatgatcatgccgctggacatgttttacatcatgccttaggtaaaaccgattatcattatcaattagaaatggccaaaaatattactgctgctgccgaagctatttatactcctgaagaagcccctgccaaaattgatcatgtgattaaaaccgccttacgcgaaaaaaaacccgtgtatttagaaattgcctgtaatattgcttctatgccttgtgctgctcctgggcctgcttctgctttatttaatgatgaagcctctgatgaagctagtttaaatgctgccgtggaagaaaccttaaaatttattgccaatcgcgataaagttgccgtgttagttggttctaaattaagagctgctggtgctgaagaagctgctgttaaatttgctgatgctttaggtggtgcagttgctactatggctgctgccaaatctttttttcccgaagaaaatccccattatattggaactagttggggagaagtttcttatcctggtgtggaaaaaactatgaaagaagccgacgctgttattgctttagcccctgtgtttaatgattattctaccactggttggactgatattcccgatcccaaaaaattagttttagccgaacctcgttctgttgttgttaatggtgttcgctttccctctgtgcatttaaaagattatttaacccgcttagcccaaaaagtttctaaaaaaactggtgccttagatttttttaaatctttaaatgcgggtgaattaaaaaaagctgctcctgctgatccttctgctcctttagttaatgctgaaattgcccgtcaagttgaagccttattaacccctaatactaccgttattgccgaaactggtgattcttggtttaatgcccaacgcatgaaattacctaatggtgcccgtgttgaatatgaaatgcaatggggtcatattggttggtctgtacctgctgcttttggttatgctgttggtgctcctgaacgtcgtaatattttaatggtgggtgatggttcttttcaattaactgcccaagaagttgcccaaatggttcgcttaaaattacccgttattatttttttaataaataattatggttataccattgaagtgatgattcatgatgggccatataataatattaaaaattgggattatgcgggtttaatggaagtgtttaatggtaatggtggttatgattctggtgctggtaaaggtttaaaagccaaaactggtggtgaattagctgaagctattaaagttgccttagccaatactgatgggccaaccttaattgaatgttttattggtcgcgaagattgtaccgaagaattagttaaatggggtaaacgtgttgctgctgctaattctcgcaaacccgtgaataaattattgtaaggatccagcaaggtttcatcccgaccccctcagggtcgggatttttttattgtgagctctgacataagtaaaggcatcccctgcgtgatataattaccttcagtttaaggaggtatacacatatgattaaagcctacgctgccctggaagccaacggaaaactccaaccctttgaatacgaccccggtgccctgggtgctaatgaggtggagattgaggtgcagtattgtggggtgtgccacagtgatttgtccatgattaataacgaatggggcatttccaattaccccctagtgccgggtcatgaggtggtgggtactgtggccgccatgggcgaaggggtgaaccatgttgaggtgggggatttagtggggctgggttggcattcgggctactgcatgacctgccatagttgtttatctggctaccacaacctttgtgccacggcggaatcgaccattgtgggccactacggtggctttggcgatcgggttcgggccaagggagtcagcgtggtgaaattacctaaaggcattgacctagccagtgccgggccccttttctgtggaggaattaccgttttcagtcctatggtggaactgagtttaaagcccactgcaaaagtggcagtgatcggcattgggggcttgggccatttagcggtgcaatttctccgggcctggggctgtgaagtgactgcctttacctccagtgccaggaagcaaacggaagtgttggaattgggcgctcaccacatactagattccaccaatccagaggcgatcgccagtgcggaaggcaaatttgactatattatctccactgtgaacctgaagcttgactggaacttatacatcagcaccctggcgccccagggacatttccactttgttggggtggtgttggagcctttggatctaaatctttttccccttttgatgggacaacgctccgtttctgcctccccagtgggtagtcccgccaccattgccaccatgttggactttgctgtgcgccatgacattaaacccgtggtggaacaatttagctttgatcagatcaacgaggcgatcgcccatctagaaagcggcaaagcccattatcgggtagtgctcagccatagtaaaaattagctctgcaaaggttgcttctagatctgtggaacgcccggttgccaccgggcgttttttattcctgcagcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatggtaagatcaagtaacgacgtaacccagcaaggtagtagacctaaaacaaagttgggaggctcaagtatgggtatcattcgcacttgtaggttagggcccgatcaagtgaaatctatgcgagctgctttagatctttttggtagagaatttggtgatgttgcaacttatagtcaacatcaaccagattccgactatttgggaaatcttttacgttctaaaacattcattgcattagcagcatttgatcaggaagctgttgtcggtgcattagccgcttatgttttacccaagtttgaacaacctcgttctgagatctatatctacgatttagcggtatctggcgagcatcgtcgccaagggatagcaacagcgttaatcaatttgttaaagcatgaagctaatgctcttggtgcctatgtgatttacgttcaagcggactatggagatgatcctgccgtagccttgtataccaaacttggaattagagaagaagttatgcactttgatattgatccttctactgctacttaacaattcgttcaagccgagatttaaattacgtacacggcggccgcgaataggaaatctcagttcagagttcggggtgttcactgcactagtcatgaacgggatttttaattcttaattcttaattcttaattatcaattatttaacgtcagttcgggtttgagaatgaaaaaaccctagggataaaggggggtttgcccctagccctttttataaaaaaagaattaaaagctaatcagaaatgaaaaaaataggcagtttaggagagaaaataattgcccagtggttaataaataaaggttattctgttatagaatcaaattggcattgtcgttggggtgaaattgaccttatagtaataaataaaagtttaaaagagattatatttgttgaagttaaaactcgcagtataaaaaattgggatgataatgggctatactctattaataacaaaaaacaagaaaaactctggttaacagctagtttatttttagaaaaaaatcaaatatttactgattggaactgtcgttttgatattgctttattaacttacaaaaaattaactaactttgggacagtattttctgttaacgataattgtttaagaccaaagtttaactatgaaggctatcaatttgaaattgttgattatttggaaaatgctttttaatctgatcttctgcacgtcaaatagtattctacaagacaattcagaatttagaatatattttttggcgttgcttaattatggtatgaaatttactgaaattatgccaaaaattgagacatcaaaatattatcattactgcaagaatgcccatttccccaaccccacctaaatgagaaatcatatacaaaactagtaaagcctatttttttgttacgagattatcccctaactttccattgaggaatcttcaattgtttatcaatgctttttctgctataattgcactcatggtaaggattgaaaacctaaattttaaggtcaattatcttaacttaatcgatagttgtctaagtataactaattgttatagttcatgaagatcaaaatatattgcattttccgcagtattgacagaaacagaagttagtaataaagcaacactatgggtatcagagaaatagttgataattcaagcgatttagaatttagaatcgttagattgatgctaatgccaatagaaatagaattaacttttattaaagaaatagctactattcctttagtctcagctcaaaattagtggactctctactaaattctgtttaggattgccttgttagttaataaattcgctattctcctgattatttttgcgaggagaaaagtcaagtatttacttttttaaaattatgtataaagatataattagtcaccgattaaaactttcattttaagatgatatgagtctaattgtgaacatggaaaagtcgggttttttaaattttacaacttttaggaaactgaaaatataaagtatgaaaaactttatttattcctgaagtcaataggacaaagttcgatgggcaaagggcaaaatgattttgcaagtaccttgacaaaccaaaaattactcgtcttaaaagactgagttttaaacccattgttctttgataaatgataaagaaacgataggataagttaataaaaaatgattttctgggaatcacaagaatttatgaagagatataaaaaaactttcctaagttaagaaaattaagaaaaactaatccatgagactacataaaaacaaggcaaaattttaagattgaactaacattaataattgatttctttaccataattactttgtcttttcataactaattgtgattaaaacagttgaaagtcagactctttttattagctttatatcgttaactaaacattatctgattgtgacaaatttaagcaaaatattttcaaaattatcaacacagaagcgaaaattttgtgaggatatcaatctagaatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctaatgcatattttaccctcgacaaatccaagaccatgcaacatttagggtagaattatttttatactcgtaatgtgattgatgtttataacccatgatttttcccgatttttctgcattttctaaccttgttcatcagggaaattttattcctgtttatcgagaattggtagcggatttagaaacccctgtttctgcttggtataaagtttgtgcagaccagccctatagtttcttgttagagtcagtagaaggtggggaaaatttaggaagatatagctttttaggttgtgatcctgtttggatactagaagcaaggggaaatcagaccaaacaagttcatcgtgatggtaaaatcgaaactttttcaggaaatccctttaacatcctctctcaatgtttagaaactattaaacctgttaaattaccagagttgccccccggtattggcggactatttggttattggggttatgagttaatttcttggattgaaccacgagtcaacgtttatcctgcctctgcggaaagtttacccgatggtatttggatgcaggtagataatttattgatttttgatcaagtaaaaagaaaaatatgggcgatcgcatatgcagatttaagacaggagcatttaagcctagaagaaatctacaatcaggcttgtgacaaaatttctaaattagttttaaaactacaattacctttaccagtatccgcaaaaccccttgaatttaaccccccgccaaaaactcaaaaaaatcatcgcattcaatacaaaagcaacaccagcaaagaggcattttgtgccaatgtggaaaaagctaaagaatacattaaagcaggagatatttttcaagtagtcatttctcagaaattacaatctcattatcaaggtcatccttttgagttgtatcgctccttacgtttgattaacccttccccttatatggcttactataactttcatggatggcagttaatcggctcttctcccgaagtaatggttaaagcagaaaaaactaatgatggtaaaaccaaagccgtagtccgtcccattgcaggaacacgtccaaggggcagaaactatcaagaagaccaatttttagcccaagacttactcaatgatcccaaagaaagggcagaacacgtcatgttagtagatttgggcagaaatgacttaggcagggtctgtgtaaaaggaagcgtggaagtcgatgaattgatggttattgaacgttattcccacgtaatgcacatagtcagtaacgttgtgggagagttagcaggggattactgtgcatgggatttactaaaggcggctttccccgcaggtacggtaagtggagctcctaaaattcgagcaatggaaattattaatgaacttgaacccgaaaggaggggaccttattctggggtttatggttactatgattttgaaggacagttaaatactgctatcacaattagaacgatggttgtggaaaccctttctgggacggaaaatcacttggtatccgttcaagctggagcaggcttagtcgctgactcagatccagacaaggagtatcaagaaactttgaataaagctagaggtttgctagaggcgattagtagcttaagctaagtgaaaattcgtaataaaaaagagcaaatttttgtgactttaaacctgacacctgaaatttatttttgaactccgaacccaaataatgattcaggttgcttaaactcagagaatcattaataattgattcttgttaactcaattgtcatttttaacatgggtgttgaactccgaagctatgtctatctcgatcgattacaacctcaacacgcttcctatataggtacggttgctctaggatttttacctttacccggtgatgcttctttatggattgaaatatcccccggaattgaaataaatcgaattactgatgtggctttgaagtctgctgg

SEQ ID NO: 109 - DNA, 9050 bp, Cyanobacterium sp. ABICyano1
tcgacaattaataacttcttcctgtacgggcgaatggccatttgctcctaactaactccgtactgctttgcggaacgagcgtagcgaactctccgaattactaagccttcatccctgatagatgcaaaaaacgaattaaaattatgtgtaaaaagaaaatgtgtctttatttagtagtcaaagttacaaaatattaagaatcaaattaataatgtattgggcagttaagtatataagtctttaaatatttatttgtattcaatatattaaccgaggacaaattatgaattcttataccgtgggtacttatttagccgaacgcttagtgcaaattggtttaaaacatcattttgccgtggctggggactataatttagtgttattggataacttattattaaataaaaacatggaacaagtgtattgttgtaatgaattaaattgtggtttttctgctgaaggttatgctagagctaaaggtgcagctgctgctgttgttacttattctgtgggtgctttatctgcttttgatgctattggtggtgcttatgccgaaaatttacccgtgattttaatttctggtgcccctaataataatgatcatgccgctggacatgttttacatcatgccttaggtaaaaccgattatcattatcaattagaaatggccaaaaatattactgctgctgccgaagctatttatactcctgaagaagcccctgccaaaattgatcatgtgattaaaaccgccttacgcgaaaaaaaacccgtgtatttagaaattgcctgtaatattgcttctatgccttgtgctgctcctgggcctgcttctgctttatttaatgatgaagcctctgatgaagctagtttaaatgctgccgtggaagaaaccttaaaatttattgccaatcgcgataaagttgccgtgttagttggttctaaattaagagctgctggtgctgaagaagctgctgttaaatttgctgatgctttaggtggtgcagttgctactatggctgctgccaaatctttttttcccgaagaaaatccccattatattggaactagttggggagaagtttcttatcctggtgtggaaaaaactatgaaagaagccgacgctgttattgctttagcccctgtgtttaatgattattctaccactggttggactgatattcccgatcccaaaaaattagttttagccgaacctcgttctgttgttgttaatggtgttcgctttccctctgtgcatttaaaagattatttaacccgcttagcccaaaaagtttctaaaaaaactggtgccttagatttttttaaatctttaaatgcgggtgaattaaaaaaagctgctcctgctgatccttctgctcctttagttaatgctgaaattgcccgtcaagttgaagccttattaacccctaatactaccgttattgccgaaactggtgattcttggtttaatgcccaacgcatgaaattacctaatggtgcccgtgttgaatatgaaatgcaatggggtcatattggttggtctgtacctgctgcttttggttatgctgttggtgctcctgaacgtcgtaatattttaatggtgggtgatggttcttttcaattaactgcccaagaagttgcccaaatggttcgcttaaaattacccgttattatttttttaataaataattatggttataccattgaagtgatgattcatgatgggccatataataatattaaaaattgggattatgcgggtttaatggaagtgtttaatggtaatggtggttatgattctggtgctggtaaaggtttaaaagccaaaactggtggtgaattagctgaagctattaaagttgccttagccaatactgatgggccaaccttaattgaatgttttattggtcgcgaagattgtaccgaagaattagttaaatggggtaaacgtgttgctgctgctaattctcgcaaacccgtgaataaattattgtaaggatccagcaaggtttcatcccgaccccctcagggtcgggatttttttattgtgagctctgacataagtaaaggcatcccctgcgtgatataattaccttcagtttaaggaggtatacacatatgattaaagcctacgctgccctggaagccaacggaaaactccaaccctttgaatacgaccccggtgccctgggtgctaatgaggtggagattgaggtgcagtattgtggggtgtgccacagtgatttgtccatgattaataacgaatggggcatttccaattaccccctagtgccgggtcatgaggtggtgggtactgtggccgccatgggcgaaggggtgaaccatgttgaggtgggggatttagtggggctgggttggcattcgggctactgcatgacctgccatagttgtttatctggctaccacaacctttgtgccacggcggaatcgaccattgtgggccactacggtggctttggcgatcgggttcgggccaagggagtcagcgtggtgaaattacctaaaggcattgacctagccagtgccgggccccttttctgtggaggaattaccgttttcagtcctatggtggaactgagtttaaagcccactgcaaaagtggcagtgatcggcattgggggcttgggccatttagcggtgcaatttctccgggcctggggctgtgaagtgactgcctttacctccagtgccaggaagcaaacggaagtgttggaattgggcgctcaccacatactagattccaccaatccagaggcgatcgccagtgcggaaggcaaatttgactatattatctccactgtgaacctgaagcttgactggaacttatacatcagcaccctggcgccccagggacatttccactttgttggggtggtgttggagcctttggatctaaatctttttccccttttgatgggacaacgctccgtttctgcctccccagtgggtagtcccgccaccattgccaccatgttggactttgctgtgcgccatgacattaaacccgtggtggaacaatttagctttgatcagatcaacgaggcgatcgcccatctagaaagcggcaaagcccattatcgggtagtgctcagccatagtaaaaattagctctgcaaaggttgcttctagatctgtggaacgcccggttgccaccgggcgttttttattcctgcagtgagaaaaagtgtaaacaaatattaagaaaaagatcagaaaaatttaacaacacgtaataaaaaaatgcgtcactacgggttataaatttacatgaaaggttaaaacacttttctgagacgattttgataaaaaagttgtcaaaaaattaagtttctttacaaatgcttaacaaaaacttggttttaagcacaaaataagagagactaatttgcagaagttttacaaggaaatcttgaagaaaaagatctaagtaaaacgactctgtttaaccaaaatttaacaaatttaacaaaacaaactaaatctattaggagattaactaaaaccatggtaagatcaagtaacgacgtaacccagcaaggtagtagacctaaaacaaagttgggaggctcaagtatgggtatcattcgcacttgtaggttagggcccgatcaagtgaaatctatgcgagctgctttagatctttttggtagagaatttggtgatgttgcaacttatagtcaacatcaaccagattccgactatttgggaaatcttttacgttctaaaacattcattgcattagcagcatttgatcaggaagctgttgtcggtgcattagccgcttatgttttacccaagtttgaacaacctcgttctgagatctatatctacgatttagcggtatctggcgagcatcgtcgccaagggatagcaacagcgttaatcaatttgttaaagcatgaagctaatgctcttggtgcctatgtgatttacgttcaagcggactatggagatgatcctgccgtagccttgtataccaaacttggaattagagaagaagttatgcactttgatattgatccttctactgctacttaacaattcgttcaagccgagatttaaattacgtacacggcggccgcgaataggaaatctcagttcagagttcggggtgttcactgcactagtcatgaacgggatttttaattcttaattcttaattcttaattatcaattatttaacgtcagttcgggtttgagaatgaaaaaaccctagggataaaggggggtttgcccctagccctttttataaaaaaagaattaaaagctaatcagaaatgaaaaaaataggcagtttaggagagaaaataattgcccagtggttaataaataaaggttattctgttatagaatcaaattggcattgtcgttggggtgaaattgaccttatagtaataaataaaagtttaaaagagattatatttgttgaagttaaaactcgcagtataaaaaattgggatgataatgggctatactctattaataacaaaaaacaagaaaaactctggttaacagctagtttatttttagaaaaaaatcaaatatttactgattggaactgtcgttttgatattgctttattaacttacaaaaaattaactaactttgggacagtattttctgttaacgataattgtttaagaccaaagtttaactatgaaggctatcaatttgaaattgttgattatttggaaaatgctttttaatctgatcttctgcacgtcaaatagtattctacaagacaattcagaatttagaatatattttttggcgttgcttaattatggtatgaaatttactgaaattatgccaaaaattgagacatcaaaatattatcattactgcaagaatgcccatttccccaaccccacctaaatgagaaatcatatacaaaactagtaaagcctatttttttgttacgagattatcccctaactttccattgaggaatcttcaattgtttatcaatgctttttctgctataattgcactcatggtaaggattgaaaacctaaattttaaggtcaattatcttaacttaatcgatagttgtctaagtataactaattgttatagttcatgaagatcaaaatatattgcattttccgcagtattgacagaaacagaagttagtaataaagcaacactatgggtatcagagaaatagttgataattcaagcgatttagaatttagaatcgttagattgatgctaatgccaatagaaatagaattaacttttattaaagaaatagctactattcctttagtctcagctcaaaattagtggactctctactaaattctgtttaggattgccttgttagttaataaattcgctattctcctgattatttttgcgaggagaaaagtcaagtatttacttttttaaaattatgtataaagatataattagtcaccgattaaaactttcattttaagatgatatgagtctaattgtgaacatggaaaagtcgggttttttaaattttacaacttttaggaaactgaaaatataaagtatgaaaaactttatttattcctgaagtcaataggacaaagttcgatgggcaaagggcaaaatgattttgcaagtaccttgacaaaccaaaaattactcgtcttaaaagactgagttttaaacccattgttctttgataaatgataaagaaacgataggataagttaataaaaaatgattttctgggaatcacaagaatttatgaagagatataaaaaaactttcctaagttaagaaaattaagaaaaactaatccatgagactacataaaaacaaggcaaaattttaagattgaactaacattaataattgatttctttaccataattactttgtcttttcataactaattgtgattaaaacagttgaaagtcagactctttttattagctttatatcgttaactaaacattatctgattgtgacaaatttaagcaaaatattttcaaaattatcaacacagaagcgaaaattttgtgaggatatcaatctagaatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctaatgcatattttaccctcgacaaatccaagaccatgcaacatttagggtagaattatttttatactcgtaatgtgattgatgtttataacccatgatttttcccgatttttctgcattttctaaccttgttcatcagggaaattttattcctgtttatcgagaattggtagcggatttagaaacccctgtttctgcttggtataaagtttgtgcagaccagccctatagtttcttgttagagtcagtagaaggtggggaaaatttaggaagatatagctttttaggttgtgatcctgtttggatactagaagcaaggggaaatcagaccaaacaagttcatcgtgatggtaaaatcgaaactttttcaggaaatccctttaacatcctctctcaatgtttagaaactattaaacctgttaaattaccagagttgccccccggtattggcggactatttggttattggggttatgagttaatttcttggattgaaccacgagtcaacgtttatcctgcctctgcggaaagtttacccgatggtatttggatgcaggtagataatttattgatttttgatcaagtaaaaagaaaaatatgggcgatcgcatatgcagatttaagacaggagcatttaagcctagaagaaatctacaatcaggcttgtgacaaaatttctaaattagttttaaaactacaattacctttaccagtatccgcaaaaccccttgaatttaaccccccgccaaaaactcaaaaaaatcatcgcattcaatacaaaagcaacaccagcaaagaggcattttgtgccaatgtggaaaaagctaaagaatacattaaagcaggagatatttttcaagtagtcatttctcagaaattacaatctcattatcaaggtcatccttttgagttgtatcgctccttacgtttgattaacccttccccttatatggcttactataactttcatggatggcagttaatcggctcttctcccgaagtaatggttaaagcagaaaaaactaatgatggtaaaaccaaagccgtagtccgtcccattgcaggaacacgtccaaggggcagaaactatcaagaagaccaatttttagcccaagacttactcaatgatcccaaagaaagggcagaacacgtcatgttagtagatttgggcagaaatgacttaggcagggtctgtgtaaaaggaagcgtggaagtcgatgaattgatggttattgaacgttattcccacgtaatgcacatagtcagtaacgttgtgggagagttagcaggggattactgtgcatgggatttactaaaggcggctttccccgcaggtacggtaagtggagctcctaaaattcgagcaatggaaattattaatgaacttgaacccgaaaggaggggaccttattctggggtttatggttactatgattttgaaggacagttaaatactgctatcacaattagaacgatggttgtggaaaccctttctgggacggaaaatcacttggtatccgttcaagctggagcaggcttagtcgctgactcagatccagacaaggagtatcaagaaactttgaataaagctagaggtttgctagaggcgattagtagcttaagctaagtgaaaattcgtaataaaaaagagcaaatttttgtgactttaaacctgacacctgaaatttatttttgaactccgaacccaaataatgattcaggttgcttaaactcagagaatcattaataattgattcttgttaactcaattgtcatttttaacatgggtgttgaactccgaagctatgtctatctcgatcgattacaacctcaacacgcttcctatataggtacggttgctctaggatttttacctttacccggtgatgcttctttatggattgaaatatcccccggaattgaaataaatcgaattactgatgtggctttgaagtctgctgg

SEQ ID NO: 110 - DNA, 9102 bp, Cyanobacterium sp. ABICyano1
tcgactggtcaagttactatatgtttagaaacaacaaaaaaagaagtcattataaaaataattgatacaggaattggcattaataaagaagaacaaaaattaatttttaatcgtttttatcgaatcaataaagcaagaaatagagagaaaggcagttgcggattaggtttagctattgcaaatgcgatcgcgcttaatcatggtggtagaataattttagaaagtcaagaaaatcaaggcagtatttttaccgtttatttaccgaaaatcatttcatcctaatttcatattcttttgacagaatcaaaggtaaagataaaaagagagaaacagtcatgaattcttataccgtgggtacttatttagccgaacgcttagtgcaaattggtttaaaacatcattttgccgtggctggggactataatttagtgttattggataacttattattaaataaaaacatggaacaagtgtattgttgtaatgaattaaattgtggtttttctgctgaaggttatgctagagctaaaggtgcagctgctgctgttgttacttattctgtgggtgctttatctgcttttgatgctattggtggtgcttatgccgaaaatttacccgtgattttaatttctggtgcccctaataataatgatcatgccgctggacatgttttacatcatgccttaggtaaaaccgattatcattatcaattagaaatggccaaaaatattactgctgctgccgaagctatttatactcctgaagaagcccctgccaaaattgatcatgtgattaaaaccgccttacgcgaaaaaaaacccgtgtatttagaaattgcctgtaatattgcttctatgccttgtgctgctcctgggcctgcttctgctttatttaatgatgaagcctctgatgaagctagtttaaatgctgccgtggaagaaaccttaaaatttattgccaatcgcgataaagttgccgtgttagttggttctaaattaagagctgctggtgctgaagaagctgctgttaaatttgctgatgctttaggtggtgcagttgctactatggctgctgccaaatctttttttcccgaagaaaatccccattatattggaactagttggggagaagtttcttatcctggtgtggaaaaaactatgaaagaagccgacgctgttattgctttagcccctgtgtttaatgattattctaccactggttggactgatattcccgatcccaaaaaattagttttagccgaacctcgttctgttgttgttaatggtgttcgctttccctctgtgcatttaaaagattatttaacccgcttagcccaaaaagtttctaaaaaaactggtgccttagatttttttaaatctttaaatgcgggtgaattaaaaaaagctgctcctgctgatccttctgctcctttagttaatgctgaaattgcccgtcaagttgaagccttattaacccctaatactaccgttattgccgaaactggtgattcttggtttaatgcccaacgcatgaaattacctaatggtgcccgtgttgaatatgaaatgcaatggggtcatattggttggtctgtacctgctgcttttggttatgctgttggtgctcctgaacgtcgtaatattttaatggtgggtgatggttcttttcaattaactgcccaagaagttgcccaaatggttcgcttaaaattacccgttattatttttttaataaataattatggttataccattgaagtgatgattcatgatgggccatataataatattaaaaattgggattatgcgggtttaatggaagtgtttaatggtaatggtggttatgattctggtgctggtaaaggtttaaaagccaaaactggtggtgaattagctgaagctattaaagttgccttagccaatactgatgggccaaccttaattgaatgttttattggtcgcgaagattgtaccgaagaattagttaaatggggtaaacgtgttgctgctgctaattctcgcaaacccgtgaataaattattgtaaggatccagcaaggtttcatcccgaccccctcagggtcgggatttttttattgtgagctctgacataagtaaaggcatcccctgcgtgatataattaccttcagtttaaggaggtatacacatatgattaaagcctacgctgccctggaagccaacggaaaactccaaccctttgaatacgaccccggtgccctgggtgctaatgaggtggagattgaggtgcagtattgtggggtgtgccacagtgatttgtccatgattaataacgaatggggcatttccaattaccccctagtgccgggtcatgaggtggtgggtactgtggccgccatgggcgaaggggtgaaccatgttgaggtgggggatttagtggggctgggttggcattcgggctactgcatgacctgccatagttgtttatctggctaccacaacctttgtgccacggcggaatcgaccattgtgggccactacggtggctttggcgatcgggttcgggccaagggagtcagcgtggtgaaattacctaaaggcattgacctagccagtgccgggccccttttctgtggaggaattaccgttttcagtcctatggtggaactgagtttaaagcccactgcaaaagtggcagtgatcggcattgggggcttgggccatttagcggtgcaatttctccgggcctggggctgtgaagtgactgcctttacctccagtgccaggaagcaaacggaagtgttggaattgggcgctcaccacatactagattccaccaatccagaggcgatcgccagtgcggaaggcaaatttgactatattatctccactgtgaacctgaagcttgactggaacttatacatcagcaccctggcgccccagggacatttccactttgttggggtggtgttggagcctttggatctaaatctttttccccttttgatgggacaacgctccgtttctgcctccccagtgggtagtcccgccaccattgccaccatgttggactttgctgtgcgccatgacattaaacccgtggtggaacaatttagctttgatcagatcaacgaggcgatcgcccatctagaaagcggcaaagcccattatcgggtagtgctcagccatagtaaaaattagctctgcaaaggttgcttctagatctgtggaacgcccggttgccaccgggcgttttttattcctgcagtgagaaaaagtgtaaacaaatattaagaaaaagatcagaaaaatttaacaacacgtaataaaaaaatgcgtcactacgggttataaatttacatgaaaggttaaaacacttttctgagacgattttgataaaaaagttgtcaaaaaattaagtttctttacaaatgcttaacaaaaacttggttttaagcacaaaataagagagactaatttgcagaagttttacaaggaaatcttgaagaaaaagatctaagtaaaacgactctgtttaaccaaaatttaacaaatttaacaaaacaaactaaatctattaggagattaactaaaaccatggtaagatcaagtaacgacgtaacccagcaaggtagtagacctaaaacaaagttgggaggctcaagtatgggtatcattcgcacttgtaggttagggcccgatcaagtgaaatctatgcgagctgctttagatctttttggtagagaatttggtgatgttgcaacttatagtcaacatcaaccagattccgactatttgggaaatcttttacgttctaaaacattcattgcattagcagcatttgatcaggaagctgttgtcggtgcattagccgcttatgttttacccaagtttgaacaacctcgttctgagatctatatctacgatttagcggtatctggcgagcatcgtcgccaagggatagcaacagcgttaatcaatttgttaaagcatgaagctaatgctcttggtgcctatgtgatttacgttcaagcggactatggagatgatcctgccgtagccttgtataccaaacttggaattagagaagaagttatgcactttgatattgatccttctactgctacttaacaattcgttcaagccgagatttaaattacgtacacggcggccgcgaataggaaatctcagttcagagttcggggtgttcactgcactagtcatgaacgggatttttaattcttaattcttaattcttaattatcaattatttaacgtcagttcgggtttgagaatgaaaaaaccctagggataaaggggggtttgcccctagccctttttataaaaaaagaattaaaagctaatcagaaatgaaaaaaataggcagtttaggagagaaaataattgcccagtggttaataaataaaggttattctgttatagaatcaaattggcattgtcgttggggtgaaattgaccttatagtaataaataaaagtttaaaagagattatatttgttgaagttaaaactcgcagtataaaaaattgggatgataatgggctatactctattaataacaaaaaacaagaaaaactctggttaacagctagtttatttttagaaaaaaatcaaatatttactgattggaactgtcgttttgatattgctttattaacttacaaaaaattaactaactttgggacagtattttctgttaacgataattgtttaagaccaaagtttaactatgaaggctatcaatttgaaattgttgattatttggaaaatgctttttaatctgatcttctgcacgtcaaatagtattctacaagacaattcagaatttagaatatattttttggcgttgcttaattatggtatgaaatttactgaaattatgccaaaaattgagacatcaaaatattatcattactgcaagaatgcccatttccccaaccccacctaaatgagaaatcatatacaaaactagtaaagcctatttttttgttacgagattatcccctaactttccattgaggaatcttcaattgtttatcaatgctttttctgctataattgcactcatggtaaggattgaaaacctaaattttaaggtcaattatcttaacttaatcgatagttgtctaagtataactaattgttatagttcatgaagatcaaaatatattgcattttccgcagtattgacagaaacagaagttagtaataaagcaacactatgggtatcagagaaatagttgataattcaagcgatttagaatttagaatcgttagattgatgctaatgccaatagaaatagaattaacttttattaaagaaatagctactattcctttagtctcagctcaaaattagtggactctctactaaattctgtttaggattgccttgttagttaataaattcgctattctcctgattatttttgcgaggagaaaagtcaagtatttacttttttaaaattatgtataaagatataattagtcaccgattaaaactttcattttaagatgatatgagtctaattgtgaacatggaaaagtcgggttttttaaattttacaacttttaggaaactgaaaatataaagtatgaaaaactttatttattcctgaagtcaataggacaaagttcgatgggcaaagggcaaaatgattttgcaagtaccttgacaaaccaaaaattactcgtcttaaaagactgagttttaaacccattgttctttgataaatgataaagaaacgataggataagttaataaaaaatgattttctgggaatcacaagaatttatgaagagatataaaaaaactttcctaagttaagaaaattaagaaaaactaatccatgagactacataaaaacaaggcaaaattttaagattgaactaacattaataattgatttctttaccataattactttgtcttttcataactaattgtgattaaaacagttgaaagtcagactctttttattagctttatatcgttaactaaacattatctgattgtgacaaatttaagcaaaatattttcaaaattatcaacacagaagcgaaaattttgtgaggatatcaatctagaatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctaatgcatattttaccctcgacaaatccaagaccatgcaacatttagggtagaattatttttatactcgtaatgtgattgatgtttataacccatgatttttcccgatttttctgcattttctaaccttgttcatcagggaaattttattcctgtttatcgagaattggtagcggatttagaaacccctgtttctgcttggtataaagtttgtgcagaccagccctatagtttcttgttagagtcagtagaaggtggggaaaatttaggaagatatagctttttaggttgtgatcctgtttggatactagaagcaaggggaaatcagaccaaacaagttcatcgtgatggtaaaatcgaaactttttcaggaaatccctttaacatcctctctcaatgtttagaaactattaaacctgttaaattaccagagttgccccccggtattggcggactatttggttattggggttatgagttaatttcttggattgaaccacgagtcaacgtttatcctgcctctgcggaaagtttacccgatggtatttggatgcaggtagataatttattgatttttgatcaagtaaaaagaaaaatatgggcgatcgcatatgcagatttaagacaggagcatttaagcctagaagaaatctacaatcaggcttgtgacaaaatttctaaattagttttaaaactacaattacctttaccagtatccgcaaaaccccttgaatttaaccccccgccaaaaactcaaaaaaatcatcgcattcaatacaaaagcaacaccagcaaagaggcattttgtgccaatgtggaaaaagctaaagaatacattaaagcaggagatatttttcaagtagtcatttctcagaaattacaatctcattatcaaggtcatccttttgagttgtatcgctccttacgtttgattaacccttccccttatatggcttactataactttcatggatggcagttaatcggctcttctcccgaagtaatggttaaagcagaaaaaactaatgatggtaaaaccaaagccgtagtccgtcccattgcaggaacacgtccaaggggcagaaactatcaagaagaccaatttttagcccaagacttactcaatgatcccaaagaaagggcagaacacgtcatgttagtagatttgggcagaaatgacttaggcagggtctgtgtaaaaggaagcgtggaagtcgatgaattgatggttattgaacgttattcccacgtaatgcacatagtcagtaacgttgtgggagagttagcaggggattactgtgcatgggatttactaaaggcggctttccccgcaggtacggtaagtggagctcctaaaattcgagcaatggaaattattaatgaacttgaacccgaaaggaggggaccttattctggggtttatggttactatgattttgaaggacagttaaatactgctatcacaattagaacgatggttgtggaaaccctttctgggacggaaaatcacttggtatccgttcaagctggagcaggcttagtcgctgactcagatccagacaaggagtatcaagaaactttgaataaagctagaggtttgctagaggcgattagtagcttaagctaagtgaaaattcgtaataaaaaagagcaaatttttgtgactttaaacctgacacctgaaatttatttttgaactccgaacccaaataatgattcaggttgcttaaactcagagaatcattaataattgattcttgttaactcaattgtcatttttaacatgggtgttgaactccgaagctatgtctatctcgatcgattacaacctcaacacgcttcctatataggtacggttgctctaggatttttacctttacccggtgatgcttctttatggattgaaatatcccccggaattgaaataaatcgaattactgatgtggctttgaagtctgctgg

SEQ ID NO: 111 - DNA, 14652 bp, Cyanobacterium sp. ABICyano1
tcgacaattaataacttcttcctgtacgggcgaatggccatttgctcctaactaactccgtactgctttgcggaacgagcgtagcgaactctccgaattactaagccttcatccctgatagatgcaaaaaacgaattaaaattatgtgtaaaaagaaaatgtgtctttatttagtagtcaaagttacaaaatattaagaatcaaattaataatgtattgggcagttaagtatataagtctttaaatatttatttgtattcaatatattaaccgaggacaaattatgaattcttacactgttggaacctatttagcagaacgtttagttcaaattggtctcaaacaccattttgcagtagctggtgattataatttagttttattggataacttattgttaaataagaatatggaacaagtgtattgttgtaatgaattaaactgtggtttttctgctgagggatatgctcgtgcaaaaggtgctgccgcagcagttgttacttattctgttggagcattaagtgcttttgacgctattggaggtgcttatgcagaaaatttacctgtaatcttaatctctggtgcacccaataacaacgatcacgctgctggtcatgtattgcatcatgctttaggtaaaaccgattatcattaccaattagaaatggcaaaaaatattaccgctgccgcagaagctatttatactcccgaagaagcacctgctaagatcgatcacgtaattaaaaccgctctccgtgagaaaaaacccgtatatttagaaatcgcttgcaatatcgcttctatgccttgtgcagctcctggacctgctagtgctttatttaacgatgaagcatctgatgaggctagtttaaatgccgctgttgaagaaactttgaaatttattgctaatcgtgataaagtagctgttttagttggttctaaactccgtgccgctggtgcagaagaagcggctgtaaaattcgcagatgccttaggaggtgctgttgccacaatggcagccgctaaaagttttttccccgaagaaaatcctcattacattggtacttcttggggtgaggtatcttaccctggtgtagaaaaaaccatgaaggaagctgatgcagtaattgcattagctcctgttttcaatgattactctaccactggttggactgatattccagaccccaaaaaattagttttagcagaacctcgctctgtagttgtgaatggtgttagatttcccagtgtacatctcaaagattatttaactcgtttagctcaaaaagtgagtaaaaagactggcgcactcgatttctttaaatctttaaatgctggtgaattaaagaaagcagctcctgctgatcccagtgctcctttagtgaatgccgaaatcgcaagacaagttgaagccttgttaactcctaacactaccgttattgccgagactggtgatagttggttcaatgctcaacgcatgaaattacccaatggtgctcgtgttgagtatgaaatgcaatggggtcacattggatggtctgttcctgctgcatttggatatgcagttggagcacctgagcgtagaaacattttaatggtaggtgatggttctttccaactcactgctcaagaagttgcacaaatggtacgtttaaaattgcctgttattatctttctcattaacaactatggttacaccattgaagttatgattcatgatggtccttataataacattaagaattgggattacgcaggtttaatggaggtatttaacggtaatggtggatacgacagtggagcaggtaaaggattaaaagctaaaacaggaggtgagttagctgaagcaattaaagtagctttagccaatacagatggtcctaccttaatcgaatgtttcattggacgtgaagattgtactgaagagttagttaaatggggaaagcgtgttgccgctgcaaattctcgtaaacctgtaaacaaactcttgtagttaggatccagcaagtttcatcccgaccccctcagggtcgggatttttttattgtgagctctgacataagtaaaggcatcccctgcgtgatataattaccttcagtttaaggaggtatacacatatgattaaagcctacgctgccctggaagccaacggaaaactccaaccctttgaatacgaccccggtgccctgggtgctaatgaggtggagattgaggtgcagtattgtggggtgtgccacagtgatttgtccatgattaataacgaatggggcatttccaattaccccctagtgccgggtcatgaggtggtgggtactgtggccgccatgggcgaaggggtgaaccatgttgaggtgggggatttagtggggctgggttggcattcgggctactgcatgacctgccatagttgtttatctggctaccacaacctttgtgccacggcggaatcgaccattgtgggccactacggtggctttggcgatcgggttcgggccaagggagtcagcgtggtgaaattacctaaaggcattgacctagccagtgccgggccccttttctgtggaggaattaccgttttcagtcctatggtggaactgagtttaaagcccactgcaaaagtggcagtgatcggcattgggggcttgggccatttagcggtgcaatttctccgggcctggggctgtgaagtgactgcctttacctccagtgccaggaagcaaacggaagtgttggaattgggcgctcaccacatactagattccaccaatccagaggcgatcgccagtgcggaaggcaaatttgactatattatctccactgtgaacctgaagcttgactggaacttatacatcagcaccctggcgccccagggacatttccactttgttggggtggtgttggagcctttggatctaaatctttttccccttttgatgggacaacgctccgtttctgcctccccagtgggtagtcccgccaccattgccaccatgttggactttgctgtgcgccatgacattaaacccgtggtggaacaatttagctttgatcagatcaacgaggcgatcgcccatctagaaagcggcaaagcccattatcgggtagtgctcagccatagtaaaaattagctctgcaaaggttgcttctagatctgtggaacgcccggttgccaccgggcgttttttattcctgcaggcccaatatcttgtcatacatacttatttgcctcactattagccctatatgtctctattgtatttttctttttctcctattcctagatcttgtaatgaatcattactctctgaaatatagctactaattttatggttgtttgtaaaatatattaacaaatgaacaataaatcatattttgtgttaatctaattattagacaactactgaatttatattcagatattcacagataggagaattttgattatgaattcttataccgtgggtacttatttagccgaacgcttagtgcaaattggtttaaaacatcattttgccgtggctggggactataatttagtgttattggataacttattattaaataaaaacatggaacaagtgtattgttgtaatgaattaaattgtggtttttctgctgaaggttatgctagagctaaaggtgcagctgctgctgttgttacttattctgtgggtgctttatctgcttttgatgctattggtggtgcttatgccgaaaatttacccgtgattttaatttctggtgcccctaataataatgatcatgccgctggacatgttttacatcatgccttaggtaaaaccgattatcattatcaattagaaatggccaaaaatattactgctgctgccgaagctatttatactcctgaagaagcccctgccaaaattgatcatgtgattaaaaccgccttacgcgaaaaaaaacccgtgtatttagaaattgcctgtaatattgcttctatgccttgtgctgctcctgggcctgcttctgctttatttaatgatgaagcctctgatgaagctagtttaaatgctgccgtggaagaaaccttaaaatttattgccaatcgcgataaagttgccgtgttagttggttctaaattaagagctgctggtgctgaagaagctgctgttaaatttgctgatgctttaggtggtgcagttgctactatggctgctgccaaatctttttttcccgaagaaaatccccattatattggaactagttggggagaagtttcttatcctggtgtggaaaaaactatgaaagaagccgacgctgttattgctttagcccctgtgtttaatgattattctaccactggttggactgatattcccgatcccaaaaaattagttttagccgaacctcgttctgttgttgttaatggtgttcgctttccctctgtgcatttaaaagattatttaacccgcttagcccaaaaagtttctaaaaaaactggtgccttagatttttttaaatctttaaatgcgggtgaattaaaaaaagctgctcctgctgatccttctgctcctttagttaatgctgaaattgcccgtcaagttgaagccttattaacccctaatactaccgttattgccgaaactggtgattcttggtttaatgcccaacgcatgaaattacctaatggtgcccgtgttgaatatgaaatgcaatggggtcatattggttggtctgtacctgctgcttttggttatgctgttggtgctcctgaacgtcgtaatattttaatggtgggtgatggttcttttcaattaactgcccaagaagttgcccaaatggttcgcttaaaattacccgttattatttttttaataaataattatggttataccattgaagtgatgattcatgatgggccatataataatattaaaaattgggattatgcgggtttaatggaagtgtttaatggtaatggtggttatgattctggtgctggtaaaggtttaaaagccaaaactggtggtgaattagctgaagctattaaagttgccttagccaatactgatgggccaaccttaattgaatgttttattggtcgcgaagattgtaccgaagaattagttaaatggggtaaacgtgttgctgctgctaattctcgcaaacccgtgaataaattattgtaatttttggggatcaattcgagctcagcaagtttcatcccgaccccctcagggtcgggatttttttattgtactcgagcgctcgttccgcaaagcggtacggagttagttaggggctaatgggcattctcccgtacaggaaagagttagaagttattaattatcaacaattctcctttgcctagtgcatcgttacctttttaattaaaacataaggaaaactaataatcgtaataatttaacctcaaagtgtaaagaaatgtgaaattctgacttttataacgttaaagagggaaaaattagcagtttaaaatacctagagaatagtctggggtaagcatagagaattagattagttaagttaatcaaattcagaaaaaataataatcgtaaatagttaatctgggtgtatagaaaatgatccccttcatgataagatttaaactcgaaaagcaaaagccaaaaaactaacttccattaaaagaagttgttacatataacgctataaagaaaatttatatatttggaggataccaaccatgtctcatattcaacgtgaaactagttgttctcgccctcgtttaaattctaatatggatgccgatttatatggttataaatgggctcgtgataatgttggtcaatctggtgctactatttatcgtttatatggtaaacctgatgctcctgaattattcttgaaacatggtaaaggttctgttgctaatgatgttactgatgaaatggttcgtttaaactggttgactgaatttatgcctttacctactattaaacattttattcgtactcccgatgatgcttggttattaactactgctattcctggtaaaactgcttttcaagttttagaagaatatcctgattctggtgaaaatattgttgatgctttagctgtttttttacgtcgtttacattctattcccgtttgtaattgtccttttaattctgatcgtgtttttcgtttagctcaagctcaatctcgtatgaataatggtttagttgatgcttctgattttgatgatgaacgtaatggttggcctgttgaacaagtttggaaagaaatgcacaaattgttacctttttctcctgattctgttgttactcatggtgatttttctttagataatttgatctttgatgaaggtaaattgattggttgtattgatgttggtcgtgttggtattgctgatcgttatcaagatttagctattttatggaattgtttaggtgaattttctccttctttacagaaacgtttatttcagaaatatggtattgataatcctgatatgaacaagttacaatttcatttaatgttggacgagttcttttaagaattaattcatgaccaaaatcccttaacgtgagttttcgttccactgagcgtcagaccccgtagaaaagatcaaaggatcttcttgagatcctttttttctgcgcgtaatctgctgctatttaaattacgtacacgtgttattactttgttaacgacaattgtcttaattaactgggcctcatgggccttccgctcactgcccgctttccagtcgggaaacctgtcgtgccagctctgcagatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctactgcagaagcttgttagacaccctgtcatgtattttatattatttatttcaccatacggattaagtgaaacctaatgaaaatagtactttcggagctttaactttaatgaaggtatgtttttttatagacatcgatgtctggtttaacaataggaaaaagtagctaaaactcccatgaattaaagaaataacaaggtgtctaacaacctgttattaagaatgttagaaaagacttaacatttgtgttgagtttttatagacattggtgtctagacatacggtagataaggtttgctcaaaaataaaataaaaaaagattggactaaaaaacatttaatttagtacaatttaattagttattttttcgtctcaaattttgctttgttgagcagaaatttagataaaaaaatccccgtgatcagattacaatgtcgttcattgtacgatgtgtcgaaaaatctttacgacactctaaactgaccacacgggggaaaaagaaaactgaactaataacatcatgatactcggaaaacctagcaattctcaacccctaaacaaaagaaacttccaaaaccctgaccatataaaggagtggcaacaatcagcaatcagtcaagatttgatagcagaaaatcttgtatcggttgctaatggttttgatgtactatttatcggcaataaataccgaactaacacgggtgttctgtcacggcacatattaaactcctattctcatttagaagatggtggttcgtatggtagaacatttgacccatttaccaataaagaaatgcagtgggttcaatttaaaccgaatagaccaagaaaaggttctactggtaaggtaatcaaatatgaatcgccaaaaggtgaacctacaagagttctaatgccgtttgtgcctatgaaaatatggcaacggattagcgataagttcggagtaccgattaatccgaaaaaagatactcacttttgggaatgggtaaagaataatccatcgataccgattgccattacagaaggaaataaaaaagctaattgcctattatcctatggctatcctgctattgcctttgtaggcatttggaacggattagagaaaataaatgatttctcgaaggaaaagcagttaaaagaggatttgaaatggttgttatccaacggcaaccgaaatattaatatcatctttgaccaagaccagaaacaaaaaactgtaattaatgtaaacaaagctattttcgctttatcttctctaataagtagaaatggtcataaagttaatattgtgcaatggttgccgtcaaaaggtaaaggaatagatgattatttggtagctttaccttttgagaaaagagaaaatcatttagacaacttaattaaaattgcaccatcatttaatttttggtcaactaaatacttattcaagtgtcgtaaaccagatttaaccgtaaattgccgttatttgagcgatgcagtaaaagaattacctcaagaggatatagcattaatagcacctcacggcacgggtaaaacttcattagtagctactcacgttaagaatcggagttatcacggaaggaaaactatttcattggtgcatcttgaaagtttagccaaagctaatggcaacgcacttggattatattaccgaaccgaaaataatattgaaaagcaatatcttggatttagcttatgtgtagatagttgccgtgataagattaacggcattacaactgatattatttcaggtcaagattattgccttttcattgatgaaattgaccaagtaattccacacatccttaacagtgaaactgaagtaagtaagtatagatgcaccatcattgacactttttctgaactggtgagaaatgctgaacaggtcattattgctgatgctgatttatccgatgtgacgattgacctaatagaaaacatcagaggtaaaaaactatatgtaatcaagaatgaatatcagtatcagggaatgacttttaacgccgttggttcaccattagaaatgatggcaatgatgggaaaatcggtgtcagaaggcaagaaattatttattaacaccacatcccaaaaggcaaaaagtaagtacggcacaatcgctcttgagtcttatatttttggtctaaataaagaagcaaagatattaagaatagactctgaaaccactaaaaaccctgaacatccagcctataaaatcattgaccaagacttaaataatatcctcaaagattatgattatgtcattgcctcaccttgccttcaaacaggtgtcagtattaccttaaaagggcattttgaccagcaatttaacttttccagtggaaacattacacctcattgctttttacagcaaatgtggcggttgagggatgcagaaattgaaagattctattatgtgccgaactcatctaacctcaatctcattgggaataagtcaagttcaccatcagaccttctaaagagcaataacaagatggcaacggcaacggttaaccttttgggtagaatcgactccgaatattccctagagtatgaatcgcacggcatttggcttgagacgtgggcaaaattatcagcacggcataacagttcaatgcgttgttactctgaaattcttacctatctaattacgtctcaagggcataaattaaatatcaacattccctcacctcttgcagatattaagaagctaaatgatgaggtaagtagtaacagggaaaaggtaaaaaatgagagatactctcagaggttaaactcaccagatattaacgatgcagaagctaccatactcgaatctaaagagcaaaaaatcggattgactctcaatgagagatgcaccctagaaaagcataaagttaagaagcggtatgggaatgtaaagatggatattctcacctttgatgatgatggactataccccaaactcagactattttattacctcaccatcggtaaacctcatctcaaggctaatgacagaaaagctattgccaaaatgggcaatgacaataaaggcaagattctatcaaaagacttagttaataaaacttactccgctcgtgtgaaggtcttagagattcttaaactaactgactttatcgacaatcttagagatgaactcttaataactcccaataatccagctatcaccgattttaataatcttctgctaagagctaagaaggatttaagagtattaggagtcaacatcggaaaatatccaatggccaacattaatgccgtacttactctcattggtcacaaactttctgtaatgagagatgagttcggaaaagagaaaaggataaaagtagatggtaaatcataccgatgttatcaacttgaaacattaccagattttaccaatgatactcttgactactggttagaaaatgatagccaaaaagaagtaacagcaacagaaaattactccgaaaattttaacccttcaaatagctacaatccagacagtaagacactttcagagggtgcaaatttcctatatataaataaagaagaattgcatccaaataaattgcacctagaaataaaagaaggtgctgaactttttttattcggggtaaaggtgattgtgaaaggaatcttggacggggcagtaactatattctctatgggtcaagaatacgatttatccctcaatgaactagaggggatgttaacatcatgaactttacaagaatctttttaaagggcgatcgcaccatgttaaatgatggtacatttgttcagatatttgatatttaccatgaccacgcattgggagtgacccttgaccttaagacagaaaaaattatttccgatgatgttagggtaattactgtcaaagacttattgttcgatggcacttataaaggggtaaaatcttttatgcccgataatgcccgataatgcccgattgatgctacaaaatcccataatcataagcgataatcccctaatagcttgtaattcttgaaccgtagcgattttagagtattccaaaaagaagaaataaacaccgcaaaatgtcgtatttcacatatataaaccaaggttttttgccctaaaatctttatgtttgtagtgtgatgttgggtcaaaatggtcagaaaagttgcaaggtttttatggatgcttacgcgcgcgaggggtaagcatccccaaatagttactttatcctagtccatgcccatttattgccgtcccgttcggctttaaaaaagtgccaaaactcacaaggtgcaataaaaagttctgtacctttcgcaaccctagataatctttcaacagttactttttttcctattatctcggtacaaagtttggctagtttctcttttccctctttttcaatcaagccttcttgtatgcccaactcattgattaatctctctatttttaccattatttcccgttcaggtagtttatcccctaaatcttcatcggggggcaatgtagggcattctgaaggggctttttcttctgtctggacattatctaatattgaagtaaccaaactatcttcagttttttctattcctattaattcatattcggttactgtatccgtatcaatatccgaataactatctttatccgtattagctattcggttaagtttatccgttaactcagaaacaagactatatagcggttttagcttttcttctatcctgttatctaatacggataagtttatacggttatcattatccgtattagtatcattgggcttttttggtagttctaccccctcataaaccgcttttattcccaattccaacagactgataacagtatcctttataatgggttttttgctgatatggtgaacttttgccccttccatcattgcgatactttctatctcactcatcaacttatcgcttaagtgaatctcgtatctgtttaatcccttactggttttattcatatccgtttactttattcggttaacaattctattttatacgaataaaatattatacggttaactttatacgtttaactattttatctatacggataacagtaataagttattcgtattagttatacgtttacttttatccaaataaaattagtgcatttaaactaaaagaatgattttatcggagttgatagcattggattaacctaaagatgtttataagctatatctgataagtatttaaggttattttgttattctgtttattgacattatcagaataaaagaatagaatataattgttgagagataagaggtttaagtgattatggttaagaagttagttggttatgtcagggtcagtagtgaatcgcaagaggataacactagcttacagaatcagatagagagaattgaagcatattgtatggcttttggttatgagttggtaaaaatattcaaagaggttgccactggtacaaaagcagatattgaaacccgtcctatttttaatgaagctatagaatacttgaaacaggataatgctaatggaattattgccttgaagctagaccgaatcgcacggaatgctttagatgtattgcgtttggttcgtgaaaccttagaaccacaaaataaaatgttagtgttactagatattcaggtagatacttcgacaccttcaggaaaaatgattttaactgtaatgagtgccgttgctgaactcgaaagagacatgatctatgatcgcactcaggggggtagaaagactaaagcccaaaagggcgggtatgcctacgggaaacctaaatttggctataagactgaagaaaaggaactaaaagaagattcagcacaacaggaaactattaaactaattaagagacaccgtaggtcagggaaaagctaccagaaaatagctgattatctcaatgcccaaagtattcccactaaacaaggtaagaaatggagttctagcgtcgtctatcgaatctgtcaggaaaaagctggttaagtctgtttatagatatttagaatttattgaataaaaatagtatgaacaataaatatttatggactaaccacgctcggaaacgtttaactgaacgatgggaaataaaagaatcatgggttattgataccatcgaaaatcctgaacgttcagaatttattgttgatgagtcaggggaaaaatatcattactataaaagaatagctaagtttaagaatagagtgttagaagtgataacttctgccaactcaacacccacaagaataataaccttttactttaaccgtaacatgaggaaaaatttatgattgttacttacgataatgaagttgacgcaatttattttaagttaacggaaaataaaattgatagcaccgaacctcaaacagacaggattatcattgattacgatgaaagtaataatattgttggcattgaggtattagattttaattatcttgtcaagaaaggtttaaccgttgctgatttacctttttctgaagatgaaagattaacagcttctcaatattttaattttcctgttgctatctaatccagaaggggcaataatccccttctttcatcgagttagacttaatatcacaaaagtcattttcattttaccgtttcttttccacagcgtccgtacgcccctcgttaaatctcaaaaccgacaatttatgatgtttataaaaagttactcactttaataagtatttatactcattaaagggttattctttttttgtagcctgataggttgggaaggaatatttcagattatcagatttgttgaatatttttcgtcagatacgcaaaccttacaaacataattaacaactgaaactattgatatgtctaggttttagctctatcacaggttggatctg

SEQ ID NO: 112 - DNA, 281 bp, Artificial Sequence
  Generalized sequence of nirA promoter
  misc_feature (1)..(116): n is a, c, g, or t
  misc_feature (132)..(138): n is a, c, g, or t
  misc_feature (154)..(168): n is a, c, g, or t
  misc_feature (183)..(204): n is a, c, g, or t
  misc_feature (211)..(265): n is a, c, g, or t
  misc_feature (277)..(278): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgcaaaaaacgaatnnnnnnnatgtgtaaaaagaaannnnnnnnnnnnnnngtagtcaaagttacnnnnnnnnnnnnnnnnnnnnnntaatgtnnnnnnnnnnnnnnnnnnnnnnnnnnnnnnnnnnnnnnnnnnnnnnnnnnnnnnnccgaggacaaannatg

SEQ ID NO: 113 - DNA, 282 bp, Artificial Sequence
  generalized sequence for nirA promoter
  misc_feature (1)..(116): n is a, c, g, or t
  misc_feature (132)..(138): n is a, c, g, or t
  misc_feature (154)..(168): n is a, c, g, or t
  misc_feature (183)..(204): n is a, c, g, or t
  misc_feature (211)..(265): n is a, c, g, or t
  misc_feature (278)..(279): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgcaaaaaacgaatnnnnnnnatgtgtaaaaagaaannnnnnnnnnnnnnngtagtcaaagttacnnnnnnnnnnnnnnnnnnnnnntaatgtnnnnnnnnnnnnnnnnnnnnnnnnnnnnnnnnnnnnnnnnnnnnnnnnnnnnnnnggaggatcagccnnatg

SEQ ID NO: 114 - DNA, 281 bp, Artificial Sequence
  Variation on a generalized nirA promoter with changes to the operator region and the TATA box
  misc_feature (1)..(116): n is a, c, g, or t
  misc_feature (132)..(138): n is a, c, g, or t
  misc_feature (154)..(168): n is a, c, g, or t
  misc_feature (183)..(204): n is a, c, g, or t
  misc_feature (211)..(265): n is a, c, g, or t
  misc_feature (277)..(278): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgcaaaaaacgcatnnnnnnnatgcgtaaaaagcatnnnnnnnnnnnnnnngtaatcaaagttacnnnnnnnnnnnnnnnnnnnnnntaatatnnnnnnnnnnnnnnnnnnnnnnnnnnnnnnnnnnnnnnnnnnnnnnnnnnnnnnnccgaggacaaannatg

SEQ ID NO: 115 - DNA, 280 bp, Artificial Sequence
  Variation of generalized nirA promoter.
  misc_feature (1)..(116): n is a, c, g, or t
  misc_feature (132)..(138): n is a, c, g, or t
  misc_feature (154)..(168): n is a, c, g, or t
  misc_feature (183)..(204): n is a, c, g, or t
  misc_feature (211)..(265): n is a, c, g, or t
  misc_feature (276)..(277): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgcaaaaaacgcatnnnnnnnatgcgtaaaaagcatnnnnnnnnnnnnnnngtaatcaaagttacnnnnnnnnnnnnnnnnnnnnnntaatatnnnnnnnnnnnnnnnnnnnnnnnnnnnnnnnnnnnnnnnnnnnnnnnnnnnnnnnggagtcagccnnatg

SEQ ID NO: 116 - DNA, 87 bp, Artificial Sequence
  Generalized sequence of promoter corT.
  misc_feature (4)..(10): n is a, c, g, or t
  misc_feature (57)..(71): n is a, c, g, or t
catnnnnnnngtttactcaaaaccttgacattgacactaatgttaaggtttaggctnnnnnnnnnnnnnnncaagttaaaaagcatg

SEQ ID NO: 117 - DNA, 87 bp, Artificial Sequence
  A generalized corT promoter sequence with changes to the ribosomal binding site.
  misc_feature (4)..(10): n is a, c, g, or t
  misc_feature (57)..(71): n is a, c, g, or t
catnnnnnnngtttactcaaaaccttgacattgacactaatgttaaggtttaggctnnnnnnnnnnnnnnngaggataaaaagcatg

SEQ ID NO: 118 - DNA, 87 bp, Artificial Sequence
  Generalized sequence of corT promoter having changes in the TATA box.
  misc_feature (4)..(10): n is a, c, g, or t
  misc_feature (57)..(71): n is a, c, g, or t
catnnnnnnngtttactcaaaaccttgacattgacactaatgttaaggtttagaatnnnnnnnnnnnnnnncaagttaaaaagcatg

SEQ ID NO: 119 - DNA, 87 bp, Artificial Sequence
  A generalized corT promoter sequence with changes to the ribosomal binding site and the TATA box.
  misc_feature (4)..(10): n is a, c, g, or t
  misc_feature (57)..(71): n is a, c, g, or t
catnnnnnnngtttactcaaaaccttgacattgacactaatgttaaggtttagaatnnnnnnnnnnnnnnngaggataaaaagcatg

SEQ ID NO: 120 - DNA, 96 bp, Artificial Sequence
  A generalized smtA promoter sequence.
  misc_feature (1)..(8): n is a, c, g, or t
  misc_feature (35)..(38): n is a, c, g, or t
  misc_feature (69)..(80): n is a, c, g, or t
  misc_feature (87)..(93): n is a, c, g, or t
nnnnnnnnaatacctgaataattgttcatgtgttnnnntaaaaatgtgaacaatcgttcaactatttannnnnnnnnnnnggaggtnnnnnnnatg

SEQ ID NO: 121 - DNA, 96 bp, Artificial Sequence
  A generalized sequence for smtA promoter having changes in the ribosomal binding site.
  misc_feature (1)..(8): n is a, c, g, or t
  misc_feature (35)..(38): n is a, c, g, or t
  misc_feature (69)..(78): n is a, c, g, or t
  misc_feature (90)..(93): n is a, c, g, or t
nnnnnnnnaatacctgaataattgttcatgtgttnnnntaaaaatgtgaacaatcgttcaactatttannnnnnnnnnaaggaggtgatnnnnatg

SEQ ID NO: 122 - DNA, 96 bp, Artificial Sequence
  A generalized sequence of smtA promoter having changes to the ribosomal binding site.
  misc_feature (1)..(8): n is a, c, g, or t
  misc_feature (35)..(38): n is a, c, g, or t
  misc_feature (69)..(78): n is a, c, g, or t
  misc_feature (89)..(93): n is a, c, g, or t
nnnnnnnnaatacctgaataattgttcatgtgttnnnntaaaaatgtgaacaatcgttcaactatttannnnnnnnnnaaggaggtatnnnnnatg

SEQ ID NO: 123 - DNA, 129 bp, Cyanobacterium sp. ABICyano1
gagctctagaaaaactattgacaaacccataaaaaatgagataagattatagattgtcactggtattttatactagaggcaaattatatttatatatacaaaaatgctgtataaaaaacatctcatatg

SEQ ID NO: 124 - DNA, 128 bp, Cyanobacterium sp. ABICyano1
gagctctagaaaaactattgacaaacccataaaaaatgtgatataattatagattgtcactggtattttatactagaggcaaattatatttatatatacaaaaatgctgtaggaggatcagccatatg

SEQ ID NO: 125 - protein, 575 aa, Cyanobacterium sp. ABICyano1
MTHNLPRQRWKFYPSQPHIVTDIVKHFGVSPIMAQVIANRGIDDIDSAQAYITPETVNLPSPLAEFPDLPHSIQLLKDAIASGAKIAICGDYDADGMTSTALLIRALKHLEAKVDYAIPSRMKDGYGINERIVEEFKQEGVSLILTVDNGISAYNPIKRAKELGLKVIITDHHDLPEKLPPADAILNPKLLPETSPYYGLAGVGVAYVLGVCLAQSLGKLDGLTKSLLELYTIGTIADLAPLTGVNRRWLKRGLKLLPKSDILGIQALSKCAGLTEEKKQLHSDDIGFKLGPRVNAIGRLDDPQIVIELFTTDDEQIAITKALQCEQTNHTRQELCKQIEKEAIEIIETKPIKWQEDRVLLIINNHWHHGVIGIVASRLVERYGVPVFIGTYEDEEPSIIRGSARGIEEYNIFSALQYCDDLLKKYGGHKAAGGFSFEAKNLDLIHQRLKEFSYQCLLPEYLKPLIKIDTQITFEQITFKLLQEIESLYPWGIENKAPIFWTPQVEIKSERITKTGEHLQLFISDGTRELKAIAWRWAVYSPLPKIVDIAYKLKENEWQGEKSIQLELVGIRQNL

SEQ ID NO: 126 - protein, 800 aa, Cyanobacterium sp. ABICyano1
MYKSSILWCFNPDENIPDDFFIQVNNIVNNRQQNQLKDIKYLALLLWKRNIRTKQDLEHFFNPQYIHDNNSIFAQEIDVAVARLIKGSEKQEKIIIWGDYSCDSIITTTILFTGLKNIFRAEDNQLSYYFSPRNYPKFGLNSSEIKNLADKGYKLIICAGMGSNNYQEINYANSLGLDIIIVDNTFLSVDKPPVCAWLNPHLLPKHHPDYSLSGGAFGVVAPSVIAFFLIKKLFSRLSENINLNNLLLLISLDLLQGKYDLWGNNRYLLLKGINLLKKEHNFGTQLLIEVCKRNGYHPLNTYQGISEKFNTLIGMYSNPENIINIITNEDKNKNSAYINKIEKAYFSYQDLNYTYLQYIHKQVNLLDLSNHKYLIFKGNKWNVNIINLVAKNTYNLYKLPVIILSNYDQDNIFYGFIYGFFSEYWEQVFSQKDWIIDYKLSSDGFSFFILEENITILTELISQKINNNIYHNSQTINIDLVLTIFDLNNILFQQIGIIEPYSINNPPVNIMLKNCNVNNLFEKKYDKFKGKSQNYTRDLTLEFWIEDDSCDIPFKAIWWGAKKDNLEKDKTYDIIGTIEYQYHFKSTEKIYYLRVIDLKPSNSSNRFYVKNNYISILDYRQTKKTDELVNINGKIIDKCPLKWSEINRSYQDAIAEDAATSNAQSTASPKPYKSSLILAYNHPSEKELEELWHQFLTIIKLSLQGKKSVNKESLLETLCISDLSLNKICHILPLIGVSFRIQPEEIIFSKIRETFPPENYLEAKQNFQDIISQEYLQKEYFYKVKVEKIKEYLDFQKHIY

SEQ ID NO: 127 - DNA, 1728 bp, Cyanobacterium sp. ABICyano1
atgacacataatttaccccgtcaacgttggaaattttatccttctcaacctcacatcgttacagatattgttaagcactttggggtttctcccatcatggcacaggttatcgctaatcgtggcattgacgatatagactccgcccaagcctatatcacccccgaaactgttaacttaccttctcccctcgcagagtttcccgatttaccccatagtattcaattattaaaagatgcgatcgcatctggggcaaaaatagctatctgtggagactatgatgcagacgggatgaccagtacagccttactaattagagccttaaaacaccttgaagcaaaagtagattatgctattcccagtcgtatgaaagacggttatggtattaatgaacgtattgtcgaagaatttaagcaagaaggagtaagtttaattctgacggtagataatggtatttctgcctataatcccatcaaaagggcaaaagaattaggtttaaaggttattataaccgaccatcatgacctcccagaaaaattaccccctgccgatgctattctcaatcccaaacttctcccggaaacttctccctattatggattagcaggagtcggagtagcttatgtcttaggagtttgtttggctcaatctttaggaaaattagacggtttaaccaaatctcttttagaattatacaccataggtacgatcgcagatcttgcccctttaactggggtgaatcgccgttggttaaaaagaggtttaaaactacttcctaaatcagatattctaggaattcaagccctaagtaaatgtgcaggattaacggaagaaaaaaaacagttgcattctgatgatataggttttaaattagggccaagagtcaatgctatcggtagattagatgacccacaaattgtcattgaattattcaccaccgatgacgaacaaatcgccattactaaagcattgcaatgtgagcaaactaatcatactcgtcaagaattatgcaaacaaatcgaaaaagaagccatagaaattatcgaaacaaaaccaattaaatggcaagaagatcgagtattattaattattaataatcattggcatcatggtgtaattggcatcgttgcctctcgtttagtagaacgttatggagtgccagtttttatcggtacttatgaagatgaagaaccaagtataataagaggttcagcgagaggaattgaagaatataatatattttctgctttacaatattgtgatgatttattaaagaaatatgggggtcataaagccgcaggaggttttagttttgaagcgaaaaacttagatttaattcatcaacgtttaaaagaattttcttatcaatgcttactacctgaatatttaaaacctttaattaaaatagatactcaaataacctttgaacaaataaccttcaaattattacaagaaattgagagtttatacccttggggtattgaaaataaagccccgattttttggactccccaagtagaaatcaagtctgaaagaattactaaaacaggagagcatttacaactatttatttctgatggtacaagagaactaaaagcgatcgcatggcgttgggcggtatattcacctctacctaaaatagtggatattgcctataaactaaaagaaaatgaatggcaaggagaaaaatctattcaactagaattagttggcatccgacaaaatctttga

SEQ ID NO: 128 - DNA, 2403 bp, Cyanobacterium sp. ABICyano1
atgtataaaagtagtattttatggtgttttaatcctgatgaaaatataccagacgacttttttattcaagtaaataatattgttaataatcgacaacaaaatcaactaaaagatattaaatatttagctttattattatggaaaagaaatattcgtactaaacaagatttagaacatttttttaaccctcaatatattcacgataataactctatctttgcgcaggaaattgatgttgctgttgctagattaattaaaggaagtgagaaacaagaaaaaattattatttggggtgattattcttgcgatagtattattacaactaccatcctatttactggattaaagaatatttttagagcagaagataatcaattatcctattatttttctcctagaaattatcctaaatttggattaaattcttcagaaattaaaaacttagcagataaaggttataaattaattatttgtgctggaatgggaagtaataattatcaagaaattaattatgctaatagtctaggcttagatattattatcgttgacaatacttttttatctgtagataaacctcctgtttgtgcatggcttaatcctcatcttttaccaaaacatcatcctgattattctttatctggaggtgcattcggcgtagtcgcaccttcggtgatcgcattttttcttattaaaaagttattttctcgtttgtctgaaaatattaacttaaataatttattattgttaatctctttagacttgctacaaggaaaatatgatttatggggaaataatcgatacttgcttctaaaaggaataaatttgttaaaaaaagagcataattttgggacacaacttttaatagaggtatgcaaaagaaatggttatcatcctttaaatacttatcagggaatcagtgagaaatttaatactttaataggaatgtatagtaatcctgaaaatataattaatattattactaatgaagataaaaataaaaattcagcctatataaataaaatcgagaaagcatactttagttatcaagacttaaattatacatatttacagtatatacataagcaggttaatttactggatctaagtaatcacaagtatttaatttttaaaggtaacaaatggaatgtaaatattatcaatctagttgcaaaaaatacttataatttatataaattacctgtcatcattttatctaattacgatcaagataatattttttatggttttatttatggctttttttctgagtattgggaacaagtatttagtcaaaaagattggattattgactataaattatcttcagatggtttcagtttttttatattagaagaaaatattacaattttaaccgaattgattagtcaaaaaattaacaataatatttatcataattcgcaaaccattaatatagacctagttttaactatatttgatttgaataatattctctttcaacaaataggaattattgagccttattcgataaataatcctcctgtaaatataatgcttaaaaactgtaatgttaataacttatttgagaaaaaatatgataaatttaaaggaaaaagtcagaattacactagagatttaactttagagttttggatagaagatgatagttgtgatattccgttcaaagctatttggtggggagcaaaaaaagataatcttgaaaaagataaaacttatgatattatcggcactattgagtatcaatatcacttcaaaagtactgagaaaatctattatttaagagtgattgatttaaaaccaagtaattctagtaatagattttatgtaaaaaataattacatttctattcttgattatagacaaacaaaaaaaacagatgaattagtaaatattaatggtaaaattatagataaatgccctcttaaatggtcagaaattaatcgtagttatcaggatgcgatcgccgaagatgcagctacgtcgaacgcacaatctacagcttcacctaagccttacaaaagtagtttaatcctagcttataatcatccatcagaaaaagagttagaagaattatggcatcaatttctaaccattattaaactatccctacaagggaaaaaaagcgttaacaaagagtctttattagagacattatgtatcagtgatttatccttaaataaaatttgtcatattttgcctttaattggtgttagttttcggattcagccggaagaaattatattcagtaaaatacgggagacttttcctccagaaaattatttagaagcaaagcagaattttcaagatataattagtcaagaatatttacaaaaagagtatttttataaagttaaagtagaaaaaataaaggaatatttagattttcagaaacatatttattaa

SEQ ID NO: 129 - DNA, 69 bp, Artificial Sequence
  Promoter rbc* with optimized ribosomal binding sequence.
actagttgacataagtaaaggcatcccctgcgtgatataattaccttcagtttaaggaggtatacacat

SEQ ID NO: 130 - DNA, 1252 bp, Cyanobacterium sp. 10216
acctgcctcaaggtcggggacaacagttggaaacgactgctaataccggatgagccgaataggtaaaagatttatcgccttgagaggggctcgcgtctgattagctagatggtgaggtaaaggcttaccatggcgacgatcagtagctggtctgagaggatgagcagccacactgggactgagacacggcccagactcctacgggaggcagcagtggggaattttccgcaatgggcgaaagcctgacggagcaataccgcgtgagggaggaaggctcttgggttgtaaacctcaaaacttagggaagaaaaaaatgacggtacctaatgtaagcatcggctaactccgtgccagcagccgcggtaatacggaggatgcaagcgttatccggaatcattgggcgtaaagagtccgtaggtggcacttcaagtctgctttcaaagaccgaagctcaacttcggaaagggagtggaaactgaagagctagagtatagtaggggtagagggaattcctagtgtagcggtgaaatgcgtagagattaggaagaacaccagtggcgaaggcgctctactgggcatatactgacactgagggacgaaagctaggggagcgaaagggattagatacccctgtagtcctagcggtaaacgatggatactaggcgtagtgctgtaaaagggactgtgccgaagctaacgcgttaagtatcccgcctggggagtacgcacgcaagtgtgaaactcaaaggaattgacggggacccgcacaagcggtggagtatgtggtttaattcgatgcaacgcgaagaaccttaccaaggcttgacatcctgcgaatcttgatgaaagttgagagtgcctaagggaacgcagagacaggtggtgcatggctgtcgtcagctcgtgtcgtgagatgttgggttaagtcccgcaacgagcgcaaccctcgtccttagttgccagcattaagttggggactctagggagaccgccggggagaactcggaggaaggtggggatgacgtcaagtcagcatgccccttacgtcttgggctacacacgtactacaatggttgggacaaaggggagcgaagccgcgaggtggagcgaatctcatcaaacccagccacagttcagattgcaggctgaaactcgcctgcatgaaggaggaatcgctagtaatcgcaggtcagcatactgcggtgaatccgttcccgggtcttgtacacaccgcccgtcacaccatggaagt

SEQ ID NO: 131 - DNA, 1391 bp, Cyanobacterium sp. ETS-03
gcagctacacatgcaagtcgaacgggctcttcggagctagtggcggacgggtgaggaacgcgtgagaacctgcctcaaggtcggggacaacagttggaaacgactgctaataccggatgagccgaataggtaaaagatttatcgcctagagaggggctcgcgtctgattagctagatggtgaggtaaaggcttaccatggcgacgatcagtagctggtctgagaggatgagcagccacactgggactgagacacggcccagactcctacgggaggcagcagtggggaattttccgcaatgggcgaaagcctgacggagcaataccgcgtgagggaggaaggctcttgggttgtaaacctcaaaacttagggaagaaaaaaatgacggtacctaatgtaagcatcggctaactccgtgccagcagccgcggtaatacggaggatgcaagcgttatccggaatcattgggcgtaaagagtccgtaggtggcacttcaagtctgctttcaaagaccgaagctcaacttcggaaagggagtggaaactgaagagctagagtatagtagggggtaggaggggaattcctagtgtagcggtgaaatgcgtagagattaggaagaacaccagtggcgaaggcgctctactgggcatatactgacactgagggacgaaagctaggggagcgaaagggattagatacccctgtagtcctagcggtaaacgatggatactaggcgtagtgctgttagaaggactgtgccgaagctaacgcgttaagtatcccgcctggggagtacgcacgcaagtgtgaaactcaaaggaattgacggggacccgcacaagcggtggagtatgtggtttaattcgatgcaacgcgaagaaccttaccaaggcttgacatcctgcgaatcttggagaaatctgagagtgcctaagggaacgcagagacaggtggtgcatggctgtcgtcagctcgtgtcgtgagatgttgggttaagtcccgcaacgagcgcaaccctcgtccttagttgccagcattaagttggggactctagggagaccgccggggagaactcggaggaaggtggggatgacgtcaagtcagcatgccccttacgtcttgggctacacacgtactacaatggttgggacaaaggggagcgaaaccgcgaggtggagcgaatctcatcaaacccagccacagttcagattgcaggctgaaactcgcctgcatgaaggaggaatcgctagtaatcgcaggtcagcatactgcggtgaatccgttcccgggtcttgtacacaccgcccgtcacaccatggaagttggtcacgcccgaagtcgttattctaacccaagggaagagacgccaaagtgggactagtgactggggtg

SEQ ID NO: 132 - DNA, 1474 bp, Cyanobacterium sp. ABICyano2
agagtttgatcctggctcaggatgaacgctggcggtatgcctaacacatgcaagtcgaacgggctcttcggagctagtggcggacgggtgaggaacgcgtgagaacctgcctcaaggtcggggacaacagttggaaacgactgctaataccggatgagccgaataggtaaaagatttatcgccttgagaggggctcgcgtctgattagctagatggtgaggtaaaggcttaccatggcgacgatcagtagctggtctgagaggatgagcagccacactgggactgagacacggcccagactcctacgggaggcagcagtggggaattttccgcaatgggcgaaagcctgacggagcaataccgcgtgagggaggaaggctcttgggttgtaaacctcaaaacttagggaagaaaaaaatgacggtacctaatgtaagcatcggctaactccgtgccagcagccgcggtaatacggaggatgcaagcgttatccggaatcattgggcgtaaagagtccgtaggtggcacttcaagtctgctttcaaagaccgaagctcaacttcggaaagggagtggaaactgaagagctagagtatagtaggggtagagggaattcctagtgtagcggtgaaatgcgtagagattaggaagaacaccagtggcgaaggcgctctactgggcatatactgacactgagggacgaaagctaggggagcgaaagggattagatacccctgtagtcctagcggtaaacgatggatactaggcgtagtgctgtaaaagggactgtgccgaagctaacgcgttaagtatcccgcctggggagtacgcacgcaagtgtgaaactcaaaggaattgacggggacccgcacaagcggtggagtatgtggtttaattcgatgcaacgcgaagaaccttaccaaggcttgacatcctgcgaatcttgatgaaagttgagagtgcctaagggaacgcagagacaggtggtgcatggctgtcgtcagctcgtgtcgtgagatgttgggttaagtcccgcaacgagcgcaaccctcgtccttagttgccagcattaagttggggactctagggagaccgccggggagaactcggaggaaggtggggatgacgtcaagtcagcatgccccttacgtcttgggctacacacgtactacaatggttgggacaaaggggagcgaagccgcgaggtggagcgaatctcatcaaacccagccacagttcagattgcaggctgaaactcgcctgcatgaaggaggaatcgctagtaatcgcaggtcagcatactgcggtgaatccgttcccgggtcttgtacacaccgcccgtcacaccatggaagttggtcacgcccgaagtcgttattctaacccaagtggaaggagacgccgaaggtgggactagtgactggggtgaagtcgtaacaaggtagccgtaccggaaggtgtggctggatcacct

SEQ ID NO: 133 - DNA, 1474 bp, Cyanobacterium sp. ABICyano1
agagtttgatcctggctcaggatgaacgctggcggtatgcctaacacatgcaagtcgaacggtctcttcggagatagtggcggacgggtgaggaacgcgtgagaacctgcctcaaggtcggggacaacagttggaaacgactgctaataccggatgagccgaataggtaaaagatttatcgcctagagaggggctcgcgtctgattagctagatggtgaggtaaaggcttaccatggcgacgatcagtagctggtctgagaggatgagcagccacactgggactgagacacggcccagactcctacgggaggcagcagtggggaattttccgcaatgggcgaaagcctgacggagcaataccgcgtgagggaggaaggctcttgggttgtaaacctcaaaacttagggaagaaaaaaatgacggtacctaatgtaagcatcggctaactccgtgccagcagccgcggtaatacggaggatgcaagcgttatccggaatcattgggcgtaaagagtccgtaggtggcacttcaagtctgctttcaaagaccgaagctcaacttcggaaagggagtggaaactgaagagctagagtatagtaggggtagagggaattcctagtgtagcggtgaaatgcgtagagattaggaagaacaccagtggcgaaggcgctctactgggcatatactgacactgagggacgaaagctaggggagcgaaagggattagatacccctgtagtcctagcggtaaacgatggatactaggcgtagtgctgttagaaggactgtgccgaagctaacgcgttaagtatcccgcctggggagtacgcacgcaagtgtgaaactcaaaggaattgacggggacccgcacaagcggtggagtatgtggtttaattcgatgcaacgcgaagaaccttaccaaggcttgacatcctgcgaatcttggagaaatctgagagtgcctaagggaacgcagagacaggtggtgcatggctgtcgtcagctcgtgtcgtgagatgttgggttaagtcccgcaacgagcgcaaccctcgtccttagttgccagcattaagttggggactctagggagaccgccggggagaactcggaggaaggtggggatgacgtcaagtcagcatgccccttacgtcttgggctacacacgtactacaatggttgggacaaaggggagcgaaaccgcgaggtggagcgaatctcatcaaacccagccacagttcagattgcaggctgaaactcgcctgcatgaaggaggaatcgctagtaatcgcaggtcagcatactgcggtgaatccgttcccgggtcttgtacacaccgcccgtcacaccatggaagttggtcacgcccgaagtcgttattctaacccaagtggaaggagacgccgaaggtgggactagtgactggggtgaagtcgtaacaaggtagccgtaccggaaggtgtggctggatcacct

SEQ ID NO: 134 - DNA, 1460 bp, Cyanobacterium sp. LLi5
gatgaacgctggcggtatgcttaacacatgcaagtcgaacgggcacttcggtgatagtggcgcacgggtgaggaacacgtgagaatctgcctcaaagtcggggacaacagttggaaacgactgctaataccggatgagccgcaaggtaaaagatttatcgctttgagaggagctcgcgtctgattagctagatggtgaggtaaaggcttaccatggcgacgatcagtagctggtctgagaggatgagcagccacactgggactgagacacggcccagactcctacgggaggcagcagtggggaattttccgcaatgggcgaaagcctgacggagcaataccgcgtgagggaggaaggctcttgggttgtaaacctcaaaacttagggaagaagcaagtgacggtacctaatataagcatcggctaactccgtgccagcagccgcggtaatacggaggatgcaagcgttatccggaatcattgggcgtaaagcgtccgtaggtggcatttcaagtctgctgtcaaagaccgaagctcaacttcgggccggcggtggaaactgaaaagctagagtgaagtaggggtagagggaattcctagtgtagcggtgaaatgcgtagagattaggaagaacaccagtggcgaaggcgctctactggacttaaactgacactgagggacgaaagctaagggagcgaaagggattagatacccctgtagtcttagcggtaaacgatggatactaggtgttgtctgtatcgacccggacagtgccgaagcaaacgcgttaagtatcccgcctggggagtacgcacgcaagtgtgaaactcaaaggaattgacggggacccgcacaagcggtggagtatgtggtttaattcgatgcaacgcgaagaaccttaccaaggcttgacatcctgtgaatctcgatgaaagttgagagtgccttagggaacacagagacaggtggtgcatggctgtcgtcagctcgtgtcgtgagatgttgggttaagtcccgcaacgagcgcaaccctcgtccttagttgccagcattaagttggggactctagggagactgccggggagaactcggaggaaggtggggatgacgtcaagtcagcatgccccttacgtcttgggctacacacgtactacaatggtagggacaaagggaggcgaaactgcgaagtggagcgaatcctgtcaaaccctgccccagttcagattgtaggctgaaactcgcctacatgaaggaggaatcgctagtaatcgcaggtcagcatactgcggtgaatccgttcccgggtcttgtacacaccgcccgtcacaccatggaagttggtaacatccgaagtcgttactccaacccgcaaggggggaggatgccgaaggtgggactagtgactggggtgaagtcgtaacaaggtagccgtaccggaaggtgtggctggatcacctcctt

SEQ ID NO: 135 - DNA, 1359 bp, Cyanobacterium sp. 7202
cttcggatgatagtggcggacgggtgagtaacacgtgagaatctgcccttaggtcggggacaacagttggaaacgactgctaataccggatgagctgaaaagtaaaagatttatcgcctagggaagagctcgcggctgattagctagttggtagtgtaaaggacaaccaaggcaacgatcagtagctggtctgagaggatgagcagccacactgggactgagacacggcccagactcctacgggaggcagcagtggggaattttccgcaatgggcgaaagcctgacggagcaataccgcgtgagggaggaaggctcttgggttgtaaacctcaaaactcagggaagaagaaagtgacggtacctgatataagcatcggctaactccgtgccagcagccgcggtaatacggaggatgcaagcgttatccggaatcattgggcgtaaagcgtccgtaggtggcatttcaagtctgcattcaaagaccgaggctcaacctcgggcagggtgtggaaactgaaaagctagagtacaggaggggtagagggaattcctagtgtagcggtgaaatgcgtagagattaggaagaacaccagtggcgaaggcgctctactggacatgtactgacactgagggacgaaagctagggtagcgaaagggattagatacccctgtagtcttagctgtaaacgatggatactaagtgtagcgggtataaactccggctgtgctgaagcaaacgcgttaagtatcccgcctggggagtacgcacgcaagtgtgaaactcaaaggaattgacggggacccgcacaagcggtggagtatgtggtttaattcgatgcaacgcgaagaaccttaccaagacttgacatccgatgaatctttttgaaagaagagagtgccttagggaacatcgtgacaggtggtgcatggctgtcgtcagctcgtgtcgtgagatgttgggttaagtcccgcaacgagcgcaaccctcgtccttagttgccagcattaagttggggactctagggagaccgccggggagaactcggaggaaggtggggatgacgtcaagtcagcatgccccttacgtcttgggctacacacgtactacaatggttgggacaaagggatgcgagaccgcaaggtggagcgaaacccatcaaacccagccccagttcagatcgtcggctgaaactcgccgacgtgaaggaggaatcgctagtaatcgcaggtcagcatactgcggtgaatccgttcccgggtcttgtacacaccgcccgtcacaccatggaagttggtaacatccgaagtcgttactccaaccatttatggaggagatctctggactagtgactggggtg

SEQ ID NO: 136 - DNA, 287 bp, Artificial Sequence
  promoter nirA*2
tcgacaattaataacttcttcctgtacgggcgaatggccatttgctcctaactaactccgtactgctttgcggaacgagcgtagcgaactctccgaattactaagccttcatccctgatagatgcaaaaaacgaattaaaattatgtgtaaaaagaaaatgtgtctttatttagtagtcaaagttacaaaatattaagaatcaaattaataatgtattgggcagttaagtatataagtctttaaatatttatttgtattcaatatattaaggaggatcagccttatg

SEQ ID NO: 137 - DNA, 278 bp, Artificial Sequence
  promoter nirA*3
aattaataacttcttcctgtacgggcgaatggccatttgctcctaactaactccgtactgctttgcggaacgagcgtagcgaactctccgaattactaagccttcatccctgatagatgcaaaaaacgcattaaaattatgcgtaaaaagcatatttgtctttatttagtaatcaaagttacaaattattaagaatcaaattaataatatattgggcagttaagtatataagtctttaaatatttatttgtattcaatatattaaccgaggacaaatt

SEQ ID NO: 138 - DNA, 184 bp, Artificial Sequence
  promoter nirA*4
taagccttcatccctgatagatgcaaaaaacgcattaaaattatgcgtaaaaagcatatttgtctttatttagtaatcaaagttacaaattattaagaatcaaattaataatatattgggcagttaagtatataagtctttaaatatttatttgtattcaatatattaaggaggtgatcattat

SEQ ID NO: 139 - DNA, 92 bp, Synechocystis PCC6803
tcatgacttagtttactcaaaaccttgacattgacactaatgttaaggtttaggctgagaaggtaaaaatccaagttaaaaagcatgaattc

SEQ ID NO: 140 - DNA, 92 bp, Artificial Sequence
  promoter corT*1
tcatgacttagtttactcaaaaccttgacattgacactaatgttaaggtttaggctgagaaggtaaaaatcgaggataaaaagcatgaattc

SEQ ID NO: 141 - DNA, 92 bp, Artificial Sequence
  promoter variant corT*2
tcatgacttagtttactcaaaaccttgacattgacactaatgttaaggtttagaatgagaaggtaaaaatccaagttaaaaagcatgaattc

SEQ ID NO: 142 - DNA, 92 bp, Artificial Sequence
  promoter variant corT*3
tcatgacttagtttactcaaaaccttgacattgacactaatgttaaggtttagaatgagaaggtaaaaatcgaggataaaaagcatgaattc

SEQ ID NO: 143 - DNA, 92 bp, Artificial Sequence
  promoter variant corT*4
tcatgacttagtttactcaaaaccttgacattgacactaatgttaaggtttagaatgagaaggtaaaaaaggaggtgatcaagcatgaattc

SEQ ID NO: 144 - DNA, 99 bp, Synechococcus PCC7002
atctaaacaatacctgaataattgttcatgtgttaatctaaaatgtgaacaatcgttcaactatttaagacaataccttggaggtttaaaccatgaatc

SEQ ID NO: 145 - DNA, 99 bp, Artificial Sequence
  promoter variant smtA*1
atctaaacaatacctgaataattgttcatgtgttaatctaaaatgtgaacaatcgttcaactatttaagacaataccaaggaggtgataaccatgaatc

SEQ ID NO: 146 - DNA, 99 bp, Artificial Sequence
  promoter variant smtA*2
atctaaacaatacctgaataattgttcatgtgttaatctaaaatgtgaacaatcgttcaactatttaagacaataccaaggaggtataaaccatgaatc

SEQ ID NO: 147 - DNA, 333 bp, Cyanobacterium sp. ABICyano1
tggtcaagttactatatgtttagaaacaacaaaaaaagaagtcattataaaaataattgatacaggaattggcattaataaagaagaacaaaaattaatttttaatcgtttttatcgaatcaataaagcaagaaatagagagaaaggcagttgcggattaggtttagctattgcaaatgcgatcgcgcttaatcatggtggtagaataattttagaaagtcaagaaaatcaaggcagtatttttaccgtttatttaccgaaaatcatttcatcctaatttcatattcttttgacagaatcaaaggtaaagataaaaagagagaaacagtcatg

SEQ ID NO: 148 - DNA, 436 bp, Cyanobacterium sp. ABICyano1
gttatatataaactcgaataaaattatcaatataaagtcaaactatatctatcctattttaactgctattggtaagtcccttaattagtgttggggtgaatagattttaaaagggcaaacccccctttatcctccctcgagaggggggagggcaaaaggcaaggggcaagggaaaaattaagaattaagaattaaaaactccgaacacctgtaggggcgaatagccattcgcttcccctcatccccccatctccccaacaccctaagcccctactcgttactcatttatttacatcatttatttacatcattaagaaaagtaacaaattttgacaagtagtcttttgacaggaaaaagcaaattctcgaagatgaaaacaatagaaaaaaattcaatcttacagtaacgatgaaaaaacttttaggcttaattttg

SEQ ID NO: 149 - DNA, 249 bp, Cyanobacterium sp. ABICyano1
ccaatatcttgtcatacatacttatttgcctcactattagccctatatgtctctattgtatttttctttttctcctattcctagatcttgtaatgaatcattactctctgaaatatagctactaattttatggttgtttgtaaaatatattaacaaatgaacaataaatcatattttgtgttaatctaattattagacaactactgaatttatattcagatattcacagataggagaattttgattatg

SEQ ID NO: 150 - DNA, 539 bp, Cyanobacterium sp. ABICyano1
attctgtgaattgattagatttgaggttttttaagaggttgattaccttgcctccaaaaaaatcataacacactaatgctctatatgaaagggctttagacccataggtttttgagaaaaaaacttgctaactctcggacaatgtcagcataactaaagtcaattcttttcgtactttataattgtctataatttaatatacaactgttctgaaactagtttttctctacattccttagttttatctgagtaaggttgcttgtaacttaacttcggttgggcctaaaaatatccgattaggagcaggtgtcagactttaattaattattaattattaattgcttattgccaaccctcggcgacaccactttttcatcagccccagataaagattgatgttttagttttgtttctttttatcccctaattcaactaatacaagtaaaactaaggttgtttatcaaaaatgatggttgatgtttgggtaaattttaagatattatgaaaagaaaatgaataaaaaatgaaaaatctttatg

SEQ ID NO: 151 - DNA, 78 bp, Artificial Sequence
  promoter variant orf0221*
tcatttcatcctcatttcatattctcctgtcaccatggtatggaagattaggtaaaaataaggaggatcagccatatg

SEQ ID NO: 152 - DNA, 73 bp, Artificial Sequence
  promoter variant orf0223*
tctttttcatagtgatttcataattgatagttacaataacgattattatttagtaaggaggatcagccatatg

SEQ ID NO: 153 - DNA, 70 bp, Artificial Sequence
  promoter variant orf0316*
tcatttcatcctaatttcatattcttttgacagaatcaaaggtaaagataaaaggaggatcagccatatg

SEQ ID NO: 154 - DNA, 78 bp, Artificial Sequence
  promoter orf0221 variant with improved -10 region
tcatttcatcctcatttcatattctcctgttaccatggtatggaagattaggtaaaaatgaggaaaaagtttattatg

SEQ ID NO: 155 - DNA, 74 bp, Artificial Sequence
  promoter variant orf0223 with improved -10 region
tctttttcatagtgatttcataattgatagttataataacgattattatttagtaaaaagattttcaaatcatg

SEQ ID NO: 156 - DNA, 70 bp, Artificial Sequence
  promoter variant orf0316 with improved -10 region
tcatttcatcctaatttcatattcttttgatagaatcaaaggtaaagataaaaagagagaaacagtcatg

SEQ ID NO: 157 - DNA, 249 bp, Artificial Sequence
  promoter orf3126 optimized
ccaatatcttgtcatacatacttatttgcctcactattagccctatatgtctctattgtatttttctttttctcctattcctagatcttgtaatgaatcattactctctgaaatatagctactaattttatggttgtttgtaaaatatattaacaaatgaacaataattcatttgttgtgttaatctaattattagacaattactgaatttatattcagtaattcacagataggaggatcagccatatg

SEQ ID NO: 158 - DNA, 69 bp, Artificial Sequence; identical to SEQ ID NO: 129
  optimized promoter Prbc* plasmid number 1658

SEQ ID NO: 159 - DNA, 569 bp, Cyanobacterium sp. ABICyano1
ctccgcttaaaaaatttcatttttcgatcaaaaaagacaaattattactaattagctcatggcaataaataatcagtagtaatctgttttcacattttattgttaatttttattattgctaatatcaaccttttctacttctgcttaatattttatttatgctcaatgggaaaatctgaaataagattgagaacagtgttaccaatagaagtatttaaggtttaaagcataccttaaagataacatttttttttgaaaagagtcaaattatttttgaaaggctgatatttttgatatttactaatattttatttatttctttttcccttaaaataagagctaaatctgtttttattatcatttatcaagctctattaatacctcaactttttcaagaaaaaataataataatttttccctctattctcatgaccttttaggaaaattaattttagaaaaactattgacaaacccataaaaaatgagataagattatagattgtcactggtattttatactagaggcaaattatatttatatatacaaaaatgctgtataaaaaacatct

SEQ ID NO: 160 - DNA, 287 bp, Artificial Sequence; identical to SEQ ID NO: 136
  optimized promoter PnirA*2

SEQ ID NO: 161 - DNA, 184 bp, Artificial Sequence; identical to SEQ ID NO: 138
  optimized promoter PnirA*4

What is claimed is:

1. A non-naturally occurring ethanologenic *Cyanobacterium* sp. organism comprising a genetically enhanced plasmid having a polynucleotide sequence identity of at least 85% to SEQ ID NO: 72 and wherein said genetically enhanced plasmid comprises at least one heterologous alcohol dehydrogenase (adh) gene and at least one heterologous pyruvate decarboxylase (pdc) gene wherein said adh gene encodes an alcohol dehydrogenase that has an amino acid sequence identity of at least 60% to the amino acid sequence of the enzyme encoded by nucleotides 2125 to 3135 of SEQ ID NO: 72 and is operably linked to a promoter and wherein said pdc gene encodes a pyruvate decarboxylase that has an amino acid sequence identity of at least 60% to the amino acid sequence of the enzyme encoded by nucleotides 285-1991 of SEQ ID NO: 72 and is operably linked to a promoter, and wherein said organism produces ethanol from about 0.002% (vol/vol) per day up to about 0.07% (vol/vol) per day.

2. The non-naturally occurring ethanologenic *Cyanobacterium* sp. organism of claim 1 wherein said organism is capable of producing ethanol at a rate of 0.07% (vol/vol) per day.

3. The non-naturally occurring ethanologenic *Cyanobacterium* sp. organism of claim 1 wherein said organism is capable of producing ethanol at a rate of 0.047% (vol/vol) per twelve hours.

4. The non-naturally occurring ethanologenic *Cyanobacterium* sp. organism of claim 1 wherein said organism is capable of producing ethanol at a rate of about 0.0201% (vol/vol) per day at about 114 days of growth.

5. The non-naturally occurring ethanologenic *Cyanobacterium* sp. organism of claim 1 wherein said organism produces ethanol at about 135 days of growth.

6. The non-naturally occurring ethanologenic *Cyanobacterium* sp. organism of claim 1, wherein said *Cyanobacterium* sp. organism is *Cyanobacterium* sp. ABICyano1 deposited in the American Type Culture Collection (ATCC) under ATCC accession number PTA-13311 transformed with said genetically enhanced plasmid, wherein said at least one heterologous adh gene and at least one heterologous pdc gene are expressed in a sufficient amount for the organism to produce ethanol.

7. The non-naturally occurring ethanologenic *Cyanobacterium* sp. organism of claim 6, wherein said promoter operably linked to said adh gene is constitutive, and wherein said promoter operably linked to said pdc gene is inducible.

8. The non-naturally occurring ethanologenic *Cyanobacterium* sp. organism of claim 7, wherein said promoter operably linked to said adh gene is a promoter having a polynucleotide sequence identity of greater than 90% to a promoter polynucleotide sequence selected from the group consisting of SEQ ID NO: 158 (Prbc*), SEQ ID NO: 9 (PcpcB), SEQ ID NO: 124 (PrpsL*4) and SEQ ID NO: 159 (PrpsL).

9. The non-naturally occurring ethanologenic *Cyanobacterium* sp. organism of claim 7, wherein said promoter operably linked to said pdc gene is selected from promoters inducible by the presence or absence of nitrate and/or copper.

10. The non-naturally occurring ethanologenic *Cyanobacterium* sp. organism of claim 9, wherein said promoter operably linked to said pdc gene is a promoter having a polynucleotide sequence identity of greater than 90% to a promoter polynucleotide sequence selected from the group consisting of SEQ ID NO: 10 (PnirA), SEQ ID NO: 160 (PnirA*2), SEQ ID NO: 161 (PnirA*4), SEQ ID NO: 35 (Porf0221), SEQ ID NO: 37 (Porf0223), and SEQ ID NO: 38 (Porf0316).

11. The non-naturally occurring ethanologenic *Cyanobacterium* sp. organism of claim 6, wherein said promoter operably linked to said adh gene is endogenous to *Cyanobacterium* sp., and wherein said promoter operably linked to said pdc gene is endogenous to *Cyanobacterium* sp.

12. The non-naturally occurring ethanologenic *Cyanobacterium* sp. organism of claim 11, wherein said promoter operably linked to said adh gene and said promoter operably linked to said pdc gene are selected from promoters comprising polynucleotide sequences that are 90% or more identical to the polynucleotide sequence of any of SEQ ID NOs 9-41.

13. The non-naturally occurring ethanologenic *Cyanobacterium* sp. organism of claim 11, wherein said genetically enhanced plasmid comprises a polynucleotide sequence selected from the group consisting of SEQ ID NO: 43, 72, 73, 74, 83, 84 and 106.

14. A method for producing ethanol comprising growing the non-naturally occurring ethanologenic *Cyanobacterium* sp. organism of claim 1.

15. The method of claim 14 wherein ethanol is produced from about 0.002% vol/vol ethanol per day up to about 0.07% vol/vol ethanol per day.

16. The method of claim 14 wherein said organism is capable of producing ethanol at a rate of 0.07% (vol/vol) per day.

17. The method of claim 14 wherein said organism is capable of producing ethanol at a rate of 0.047% (vol/vol) per twelve hours.

18. The method of claim 14 wherein ethanol is produced at a rate of about 0.0201% (vol/vol) per day at about 114 days of growth.

19. The method of claim 14, wherein the genetically enhanced plasmid in said non-naturally occurring ethanologenic *Cyanobacterium* sp. organism comprises a polynucleotide sequence selected from the group consisting of SEQ ID NO: 43, 72, 73, 74, 83, 84 and 106.

* * * * *